(12) United States Patent
Sobieraj et al.

(10) Patent No.: US 11,912,771 B2
(45) Date of Patent: Feb. 27, 2024

(54) MAGE-A4 PEPTIDE-MHC ANTIGEN BINDING PROTEINS

(71) Applicant: CDR-LIFE AG, Schlieren-Zurich (CH)

(72) Inventors: Anna Maria Sobieraj, Zürich (CH); Fabian Bert Scheifele, Mägenwil (CH); Stephanie Jungmichel, Zürich (CH); Leonardo Borras, Birmensdorf (CH); Christian Valdemar Vinge Leisner, Thalwil (CH)

(73) Assignee: CDR-LIFE AG, Horgen (CH)

( * ) Notice: Subject to any disclaimer, the term of this patent is extended or adjusted under 35 U.S.C. 154(b) by 0 days.

(21) Appl. No.: 17/690,526

(22) Filed: Mar. 9, 2022

(65) Prior Publication Data

US 2022/0380472 A1 Dec. 1, 2022

Related U.S. Application Data

(60) Provisional application No. 63/172,864, filed on Apr. 9, 2021, provisional application No. 63/158,691, filed on Mar. 9, 2021.

(51) Int. Cl.
 *C07K 16/28* (2006.01)
 *C07K 16/30* (2006.01)

(52) U.S. Cl.
 CPC ........ *C07K 16/2833* (2013.01); *C07K 16/30* (2013.01); *C07K 2317/31* (2013.01); *C07K 2317/35* (2013.01); *C07K 2317/55* (2013.01); *C07K 2317/569* (2013.01); *C07K 2317/622* (2013.01); *C07K 2317/92* (2013.01)

(58) Field of Classification Search
 CPC ........... C07K 16/2833; C07K 16/30; C07K 2317/31; C07K 2317/35; C07K 2317/55; C07K 2317/569; C07K 2317/622; C07K 2317/92; C07K 2317/73; C07K 2317/10; C07K 16/2809; C07K 2317/32; C07K 2317/34; C07K 2317/56; C07K 2317/565; A61P 35/00; A61K 2039/505
 See application file for complete search history.

(56) References Cited

U.S. PATENT DOCUMENTS

| | | |
|---|---|---|
| 6,710,172 B1 | 3/2004 | Chaux et al. |
| 7,199,231 B1 | 4/2007 | Guagler et al. |
| 7,311,914 B2 | 12/2007 | Zhang et al. |
| 8,003,770 B2 | 8/2011 | Shiku et al. |
| 8,623,358 B2 * | 1/2014 | Benatuil ............... A61K 45/06 424/133.1 |
| 9,802,997 B2 | 10/2017 | Mahr et al. |
| 10,859,566 B2 | 12/2020 | Flechtner et al. |
| 11,098,115 B2 | 8/2021 | Willemsen et al. |
| 11,286,289 B2 | 3/2022 | Tribble et al. |
| 11,497,768 B2 | 11/2022 | Shiku et al. |
| 11,505,590 B2 | 11/2022 | Hayes et al. |
| 2005/0033031 A1 | 2/2005 | Couto |
| 2011/0219464 A1 | 9/2011 | Domon et al. |
| 2019/0144521 A1 | 5/2019 | Tribble et al. |
| 2020/0400674 A1 | 12/2020 | Williams |
| 2020/0408769 A1 | 12/2020 | Kumaki et al. |
| 2021/0032361 A1 | 2/2021 | Hutt et al. |
| 2021/0032370 A1 | 2/2021 | Pszolla et al. |
| 2021/0061914 A1 | 3/2021 | Jooss et al. |
| 2021/0147550 A1 | 5/2021 | Jooss et al. |
| 2021/0230278 A1 | 7/2021 | Weinzierl et al. |
| 2021/0238543 A1 | 8/2021 | Renes et al. |
| 2022/0119479 A1 | 4/2022 | Conroy et al. |
| 2022/0324939 A1 | 10/2022 | Bowerman et al. |
| 2022/0340894 A1 | 10/2022 | Sobieraj et al. |
| 2023/0159612 A1 | 5/2023 | Ellinger et al. |

FOREIGN PATENT DOCUMENTS

| | | |
|---|---|---|
| CN | 108866098 A | 11/2018 |
| CN | 110333352 A | 10/2019 |
| WO | WO 2009/155725 A1 | 12/2003 |
| WO | WO 2004/016740 A2 | 2/2004 |
| WO | WO 2005/016950 A1 | 2/2005 |
| WO | WO 2008/110348 A1 | 9/2008 |
| WO | WO 2008/144757 A1 | 11/2008 |
| WO | WO 2009/000098 A2 | 12/2008 |
| WO | WO 2009/000099 A2 | 12/2008 |
| WO | WO 2009/155726 A1 | 12/2009 |
| WO | WO 2016/086196 A2 | 6/2016 |
| WO | WO 2016/199140 A1 | 12/2016 |
| WO | WO 2016/199141 A1 | 12/2016 |
| WO | WO 2017/201493 A1 | 11/2017 |
| WO | WO 2020/109616 A1 | 6/2020 |
| WO | WO 2021/016585 A1 | 1/2021 |
| WO | WO 2021/122875 A1 | 6/2021 |

(Continued)

OTHER PUBLICATIONS

Saito et. al. Vaccine. 32(45):5901-5907 (2014) (Year: 2014).*
Almagro et. al., Front. Immunol. 2018; 8:1751 (Year: 2018).*
Rudikoff et al., Proc. Nat'l Acad. Sci. USA, 79:1979-83 (1982) (Year: 1982).*
Brown et al., J. Immunol., 156(9):3285-91 (1996) (Year: 1982).*
Janeway, Immuno Biology The immune system in Health and Disease, 5th edition, 2001 (Year: 2001).*
Lydard et. al., Immunology, 2011, in Antibodies: Generation of diversity pp. 76-85 (Year: 2011).*
Gupta. Proteomics of Spermatogenesis. Chapter 32:(777-794) (2005) (Year: 2005).*
Shichijo, et al., Int. J. Cancer (Pred. Oncol.) 64:158-165. (1995) (Year: 1995).*
Sang et. al. Vaccine 29:(8496-8500) (2011) (Year: 2011).*

(Continued)

*Primary Examiner* — Jessica H Roark
*Assistant Examiner* — Francesca Edgingtongiordan
(74) *Attorney, Agent, or Firm* — LATHROP GPM LLP; James H. Velema, Esq.; Michael J. Spellberg

(57) ABSTRACT

Antigen binding proteins that specifically recognize a target Melanoma-Associated Antigen A4 (MAGE-A4) peptide-MHC (pMHC), and nucleic acids encoding the same, are provided. Methods of producing antigen binding proteins that specifically recognize a target MAGE-A4 pMHC, and nucleic acid libraries encoding the same, are also provided.

30 Claims, 18 Drawing Sheets

Specification includes a Sequence Listing.

(56) References Cited

FOREIGN PATENT DOCUMENTS

| | | | |
|---|---|---|---|
| WO | WO 2021/216972 A1 | 10/2021 | |
| WO | WO 2021/224913 A1 | 11/2021 | |
| WO | WO 2021/229234 A1 | 11/2021 | |
| WO | WO 2021/229235 A1 | 11/2021 | |
| WO | WO 2022/105924 A1 | 5/2022 | |
| WO | WO 2022/190007 A1 | 9/2022 | |
| WO | WO 2022/190009 A1 | 9/2022 | |
| WO | WO 2022/235662 A1 | 11/2022 | |
| WO | WO 2022/262678 A1 | 12/2022 | |
| WO | WO 2023/011268 A1 | 2/2023 | |
| WO | WO 2023/011273 A1 | 2/2023 | |
| WO | WO 2023/014809 A2 | 2/2023 | |
| WO | WO 2023/044402 A1 | 3/2023 | |

OTHER PUBLICATIONS

Chiu et al., Antibodies, 8(55):1-80. (2005) (Year: 2005).*
Sampei et. al. PLOS ONE 13(12):1-20. (2018) (Year: 2018).*
U.S. Appl. No. 17/690,089 2022/0340894, filed Mar. 9, 2022 Oct. 27, 2022, Anna Maria Sobieraj, Rabbit-Derived Antigen Binding Protein Nucleic Acid Libraries and Methods of Making the Same.
U.S. Appl. No. 17/690,526 2022/0380472, filed Mar. 9, 2022 Dec. 1, 2022, Anna Maria Sobieraj, Mage-A4 Peptide-MHC Antigen Binding Proteins.
Al-Lazikani et al., "Standard conformations for the canonical structures of immunoglobulins", JMB, 1997, 273(4): 927-948.
Arimilli et al., "Refolding and reconstitution of functionally active complexes of human leukocyte antigen DR2 and myelin basic protein peptide from recombinant alpha and beta polypeptide chains", J Biol Chem., Jan. 13, 1995, 270(2): 971-977.
AYYAR rabbit scFv, Appl Microbiol Biotechnol., Dec. 24, 2014, 99(6): 2693-2703.
Bird et al., "Single-chain antigen-binding proteins", Science, 1988, 242(4877): 423-426.
Chaudhary et al., "A rapid method of cloning functional variable-region antibody genes in *Escherichia coli* as single-chain immunotoxins", PNAS, 1990, 87(3): 1066-1070.
Cooper et al., "T-cell clones can be rendered specific for CD19: toward the selective augmentation of the graft-versus-B-lineage leukemia effect", Blood, 2003, 101(4): 1637-1644.
Davari et al., "Development of a CD8 co-receptor independent T-cell receptor specific for tumor-associated antigen MAGE-A4 for next generation T-cell-based immunotherapy", Journal for Immuno Therapy of Cancer, Feb. 17, 2021, 9(3): e002035.
Davis et al., "Ligand recognition by alpha beta T cell receptors", Annu Rev Immunol., 1998, 16: 523-544.
Gertz et al., "Accuracy and coverage assessment of*Oryctolagus cuniculus*(rabbit) genes encoding immunoglobulins in the whole genome sequence assembly (OryCun2.0) and localization of theIGHlocus to chromosome 20", Immunogenetics, Aug. 8, 2013, 65(10): 749-762.
Grossman et al., "Toward a Shared Vision for Cancer Genomic Data", N Engl J Med., 2016, 375: 1109-1112.
Heeley et al., "Mutations Flanking the Polyglutamine Repeat in the Modulatory Domain of Rat Glucocorticoid Receptor Lead to an Increase in Affinity for Hormone", Endocr Res, 2002, 28(3): 217-229.
Honegger et al., "Yet another numbering scheme for immunoglobulin variable domains: an automatic modeling and analysis tool," J Mol Biol, Jun. 8, 2001; 309(3): 657-670.
Hossler, "Optimal and consistent protein glycosylation in mammalian cell culture", Glycobiology, Jun. 3, 2009, 19(9): 936-949.
International Search Report and Written Opinion for PCT International Patent Application No. PCT/IB2022/052117, dated Aug. 1, 2022.
International Search Report and Written Opinion for PCT International Patent Application No. PCT/IB2022/052119, dated Aug. 3, 2022.
Kim et al., "Hybrid restriction enzymes: zinc finger fusions to Fok I cleavage domain", PNAS, 1996, 93(3): 1156-1160.
Lefranc et al., "IMGT unique numbering for immunoglobulin and T cell receptor variable domains and Ig superfamily V-like domains," Dev Comp Immunol, Jan. 2003, 27(1): 55-77.
Liljeblad et al., "Analysis of agalacto-IgG in rheumatoid arthritis using surface plasmon resonance", Glyco Journ., 2000, 17: 323-329.
Liu et al., "Design of polydactyl zinc-finger proteins for unique addressing within complex genomes", PNAS USA, 1997, 94(11): 5525-5530.
MacCallum et al., "Antibody-antigen interactions: Contact analysis and binding site topography", J. Mol. Biol., 1996, 262: 732-745.
Maus et al., "Antibody-modified T cells: CARs take the front seat for hematologic malignancies", Blood, 2014, 123(17): 2625-2635.
Popkov et al., "Rabbit Immune Repertoires as Sources for Therapeutic Monoclonal Antibodies: The Impact of Kappa Allotype-correlated Variation in Cysteine Content on Antibody Libraries Selected by Phage Display", Journal of Molecular Biology, Jan. 10, 2003, 325(2): 325-335.
Rodenko et al., "Generation of peptide-MHC class I complexes through UV- mediated ligand exchange", Nat. Protoc., 2006, 1(3): 1120-1132.
Rudolph et al., "How TCRs bind MHCs, peptides, and coreceptors", Annu Rev Immunol., 2006, 24: 419-466.
Sanderson et al., "Preclinical evaluation of an affinity-enhanced MAGE-A4-specific T-cell receptor for adoptive T-cell therapy", Oncoimmunology, Nov. 24, 2019, 9(1): 1682381.
Tian et al., "CD8+ T Cell Activation Is Governed by TCR-Peptide/MHC Affinity, Not Dissociation Rate", J Immunol., 2007, 179(5): 2952-2960.
AACR 2021—Abstract LB167: A powerful discovery platform for the generation of high affinity and specificity TCR-like antibodies for immunotherapies in solid tumor, Jul. 1, 2021, Proceedings: AACR Annual Meeting 2021, 81(13): Supplement.
AACR 2022—Abstract 2891: Enhanced anti-tumor responses with a novel dual pMHC T-cell engager bispecific antibody, Jun. 15, 2022, Proceedings: AACR Annual Meeting 2022, 82(12): Supplement.

* cited by examiner

MAGE-A4 PEPTIDE-MHC ANTIGEN BINDING PROTEINS

RELATED APPLICATIONS

This application claims the benefit of U.S. Provisional Application Ser. No. 63/158,691, filed Mar. 9, 2021, and U.S. Provisional Application Ser. No. 63/172,864, filed Apr. 9, 2021, the entire disclosures of which are hereby incorporated herein by reference.

SEQUENCE LISTING

The instant application contains a Sequence Listing which has been submitted electronically in ASCII format and is hereby incorporated by reference in its entirety. Said ASCII copy, created on Jun. 30, 2022, is named 727171_CDR9-006_ST25.txt and is 583,458 bytes in size.

FIELD OF THE INVENTION

This disclosure relates to antigen binding proteins that specifically recognize a target Melanoma-Associated Antigen A4 (MAGE-A4) peptide-MHC (pMHC).

BACKGROUND

Melanoma-Associated Antigen A4 (MAGE-A4) peptide-MHC (pMHC) expression is present in a number of cancers, including non-small cell lung cancer (NSCLC), melanoma, bladder, head and neck, and gastroesophageal cancers (Grossman et al. N Engl J Med. 2016. 375: 1109-1112). It represents an attractive target for TCR-based T cell therapy, unfortunately TCR molecules possess low binding affinity for their pMHC targets. Moreover, TCR-based T cell therapies are laborious and costly to develop and use. In contrast, isolated monoclonal antibodies offer substantially higher binding affinities for their target with potentially reduced off-target activity. However, it is difficult to generate monoclonal antibodies against pMHC targets due to the small epitope of the bound peptide in the HLA.

Accordingly, there is a need in the art for novel antigen binding proteins that specifically recognize target MAGE-A4 pMHC with high binding affinity while retaining high specificity (i.e., low to no off-target effects).

SUMMARY

In one aspect, the disclosure provides an antigen binding protein that specifically recognizes a target Melanoma-Associated Antigen A4 (MAGE-A4) peptide-MHC (pMHC), wherein the antigen binding protein comprises one or more of the following characteristics: (i) the antigen binding protein comprises a binding affinity for the target MAGE-A4 pMHC of about $10^{-9}$ M to about $10^{-14}$ M (e.g., about $10^{-9}$ M, $10^{-10}$ M, $10^{-11}$ M, $10^{-12}$ M, $10^{-13}$ M, or $10^{-14}$ M); (ii) the antigen binding protein comprises a binding affinity for a non-MAGE-A4 pMHC and/or a peptide-free MHC of about $10^{-6}$ M or weaker (e.g., about $10^{-6}$ M, $10^{-5}$ M, $10^{-4}$ M, $10^{-3}$ M, $10^{-2}$ M, or $10^{-1}$ M); (iii) the antigen binding protein comprises a binding affinity for a non-target MAGE-A4 pMHC of about $10^{-6}$ M or weaker (e.g., about $10^{-6}$ M, $10^{-5}$ M, $10^{-4}$ M, $10^{-3}$ M, $10^{-2}$ M, or $10^{-1}$ M); and (iv) the antigen binding protein comprises a binding affinity for the target MAGE-A4 pMHC of about $10^{-9}$ M to about $10^{-14}$ M (e.g., about $10^{-9}$ M, $10^{-10}$ M, $10^{-11}$ M, $10^{-12}$ M, $10^{-13}$ M, or $10^{-14}$ M), and a binding affinity for the MAGE-A4 peptide, an HLA polypeptide, and a beta-2-microglobuin polypeptide alone of about $10^{-6}$ M or weaker (e.g., about $10^{-6}$ M, $10^{-5}$M, $10^{-4}$ M, $10^{-3}$ M, $10^{-2}$ M, or $10^{-1}$ M).

In certain embodiments, the antigen binding protein comprises specificity for a MAGE-A4 peptide amino acid sequence set forth in SEQ ID NO: 3 (GVYDGREHTV).

In certain embodiments, the MAGE-A4 peptide is in complex with an HLA-A2 polypeptide. In certain embodiments, the HLA-A2 polypeptide comprises the amino acid sequence set forth in SEQ ID NO: 1.

In certain embodiments, the beta-2-microglobuin polypeptide comprises the amino acid sequence set forth in SEQ ID NO: 2.

In certain embodiments, the antigen binding protein lacks detectable binding affinity for a MAGE-A4 peptide comprising one or more mutations (e.g., substitutions, deletions, and/or insertions) in the amino acid sequence set forth in SEQ ID NO: 3 (GVYDGREHTV).

In certain embodiments, the antigen binding protein lacks detectable binding affinity for a MAGE-A4 peptide comprising one, two, three, four, or five mutations (e.g., substitutions, deletions, and/or insertions) in the amino acid sequence set forth in SEQ ID NO: 3 (GVYDGREHTV).

In certain embodiments, the antigen binding protein lacks detectable binding affinity for a MAGE-A4 peptide comprising the amino acid sequence set forth in one or more of SEQ ID NO: 394 (GLADGRTHTV), SEQ ID NO: 395 (GLYDGPVHEV), and SEQ ID NO: 396 (GVFDGLHTV).

In certain embodiments, the antigen binding protein lacks detectable binding affinity for a MAGE-A4 peptide comprising the amino acid sequence set forth in SEQ ID NO: 394 (GLADGRTHTV), SEQ ID NO: 395 (GLYDGPVHEV), and SEQ ID NO: 396 (GVFDGLHTV).

In certain embodiments, the antigen binding protein comprises a binding affinity for a MAGE-A4 peptide comprising one or more mutations (e.g., substitutions, deletions, and/or insertions) in the amino acid sequence set forth in SEQ ID NO: 3 (GVYDGREHTV), of about $10^{-6}$ M or weaker (e.g., about $10^{-6}$ M, $10^{-5}$ M, $10^{-4}$ M, $10^{-3}$ M, $10^{-2}$ M, or $10^{-1}$ M).

In certain embodiments, the antigen binding protein comprises a binding affinity for a MAGE-A4 peptide comprising one, two, three, four, or five mutations (e.g., substitutions, deletions, and/or insertions) in the amino acid sequence set forth in SEQ ID NO: 3 (GVYDGREHTV), of about $10^{-6}$ M or weaker (e.g., about $10^{-6}$ M, $10^{-5}$ M, $10^{-4}$ M, $10^{-3}$ M, $10^{-2}$ M, or $10^{-1}$ M).

In certain embodiments, the antigen binding protein lacks detectable binding affinity for a peptide comprising the amino acid sequence set forth in one or more of SEQ ID NO: 345 to SEQ ID NO: 393.

In certain embodiments, the antigen binding protein lacks detectable binding affinity for a peptide mixture comprising the amino acid sequences set forth in SEQ ID NO: 345 to SEQ ID NO: 393.

In certain embodiments, the antigen binding protein comprises a binding affinity for a MAGE-A4 peptide comprising the amino acid sequence set forth in one or more of SEQ ID NO: 394 (GLADGRTHTV), SEQ ID NO: 395 (GLYDGPVHEV), and SEQ ID NO: 396 (GVFDGLHTV), of about $10^{-6}$M or weaker (e.g., about $10^{-6}$ M, $10^{-5}$M, $10^{-4}$ M, $10^{-3}$ M, $10^{-2}$ M, or $10^{-1}$ M).

In certain embodiments, the antigen binding protein comprises a binding affinity for a MAGE-A4 peptide comprising the amino acid sequence set forth in SEQ ID NO: 394 (GLADGRTHTV), SEQ ID NO: 395 (GLYDGPVHEV), and SEQ ID NO: 396 (GVFDGLHTV), of about $10^{-6}$ M or weaker (e.g., about $10^{-6}$ M, $10^{-5}$ M, $10^{-4}$ M, $10^{-3}$ M, $10^{-2}$ M, or $10^{-1}$ M).

In certain embodiments, the antigen binding protein comprises a binding affinity for a peptide comprising the amino acid sequence set forth in one or more of SEQ ID NO: 345 to SEQ ID NO: 393, of about $10^{-6}$ M or weaker (e.g., about $10^{-6}$ M, $10^{-5}$ M, $10^{-4}$ M, $10^{-3}$ M, $10^{-2}$ M, or $10^{-1}$ M).

In certain embodiments, the antigen binding protein comprises a binding affinity for a peptide mixture comprising the amino acid sequences set forth in SEQ ID NO: 345 to SEQ ID NO: 393, of about $10^{-6}$ M or weaker (e.g., about $10^{-6}$ M, $10^{-5}$ M, $10^{-4}$ M, $10^{-3}$ M, $10^{-2}$ M, or $10^{-1}$ M).

In certain embodiments, the antigen binding protein comprises a single chain variable fragment (scFv), a Fab fragment, a Fab' fragment, a Fv fragment, a diabody, a small antibody mimetic or a single domain antibody, such as a sdAb, a sdFv, a nanobody, a V-Nar or a VHH.

In certain embodiments, the antigen binding protein comprises: (a) an antibody heavy chain variable (VH) domain comprising an HCDR1 amino acid sequence, an HCDR2 amino acid sequence, and an HCDR3 amino acid sequence as set forth in M0848 of Table 6, and an antibody light chain variable (VL) domain comprising an LCDR1 amino acid sequence, an LCDR2 amino acid sequence, and an LCDR3 amino acid sequence as set forth in M0848 of Table 6; (b) an antibody heavy chain variable (VH) domain comprising an HCDR1 amino acid sequence, an HCDR2 amino acid sequence, and an HCDR3 amino acid sequence as set forth in M0849 of Table 6, and an antibody light chain variable (VL) domain comprising an LCDR1 amino acid sequence, an LCDR2 amino acid sequence, and an LCDR3 amino acid sequence as set forth in M0849 of Table 6; (c) an antibody heavy chain variable (VH) domain comprising an HCDR1 amino acid sequence, an HCDR2 amino acid sequence, and an HCDR3 amino acid sequence as set forth in M0850 of Table 6, and an antibody light chain variable (VL) domain comprising an LCDR1 amino acid sequence, an LCDR2 amino acid sequence, and an LCDR3 amino acid sequence as set forth in M0850 of Table 6; (d) an antibody heavy chain variable (VH) domain comprising an HCDR1 amino acid sequence, an HCDR2 amino acid sequence, and an HCDR3 amino acid sequence as set forth in M0851 of Table 6, and an antibody light chain variable (VL) domain comprising an LCDR1 amino acid sequence, an LCDR2 amino acid sequence, and an LCDR3 amino acid sequence as set forth in M0851 of Table 6; (e) an antibody heavy chain variable (VH) domain comprising an HCDR1 amino acid sequence, an HCDR2 amino acid sequence, and an HCDR3 amino acid sequence as set forth in M0852 of Table 6, and an antibody light chain variable (VL) domain comprising an LCDR1 amino acid sequence, an LCDR2 amino acid sequence, and an LCDR3 amino acid sequence as set forth in M0852 of Table 6; (f) an antibody heavy chain variable (VH) domain comprising an HCDR1 amino acid sequence, an HCDR2 amino acid sequence, and an HCDR3 amino acid sequence as set forth in M0853 of Table 6, and an antibody light chain variable (VL) domain comprising an LCDR1 amino acid sequence, an LCDR2 amino acid sequence, and an LCDR3 amino acid sequence as set forth in M0853 of Table 6; (g) an antibody heavy chain variable (VH) domain comprising an HCDR1 amino acid sequence, an HCDR2 amino acid sequence, and an HCDR3 amino acid sequence as set forth in M0854 of Table 6, and an antibody light chain variable (VL) domain comprising an LCDR1 amino acid sequence, an LCDR2 amino acid sequence, and an LCDR3 amino acid sequence as set forth in M0854 of Table 6; (h) an antibody heavy chain variable (VH) domain comprising an HCDR1 amino acid sequence, an HCDR2 amino acid sequence, and an HCDR3 amino acid sequence as set forth in M0855 of Table 6, and an antibody light chain variable (VL) domain comprising an LCDR1 amino acid sequence, an LCDR2 amino acid sequence, and an LCDR3 amino acid sequence as set forth in M0855 of Table 6; (i) an antibody heavy chain variable (VH) domain comprising an HCDR1 amino acid sequence, an HCDR2 amino acid sequence, and an HCDR3 amino acid sequence as set forth in M0856 of Table 6, and an antibody light chain variable (VL) domain comprising an LCDR1 amino acid sequence, an LCDR2 amino acid sequence, and an LCDR3 amino acid sequence as set forth in M0856 of Table 6; (j) an antibody heavy chain variable (VH) domain comprising an HCDR1 amino acid sequence, an HCDR2 amino acid sequence, and an HCDR3 amino acid sequence as set forth in M0857 of Table 6, and an antibody light chain variable (VL) domain comprising an LCDR1 amino acid sequence, an LCDR2 amino acid sequence, and an LCDR3 amino acid sequence as set forth in M0857 of Table 6; (k) an antibody heavy chain variable (VH) domain comprising an HCDR1 amino acid sequence, an HCDR2 amino acid sequence, and an HCDR3 amino acid sequence as set forth in M0858 of Table 6, and an antibody light chain variable (VL) domain comprising an LCDR1 amino acid sequence, an LCDR2 amino acid sequence, and an LCDR3 amino acid sequence as set forth in M0858 of Table 6; (l) an antibody heavy chain variable (VH) domain comprising an HCDR1 amino acid sequence, an HCDR2 amino acid sequence, and an HCDR3 amino acid sequence as set forth in M0859 of Table 6, and an antibody light chain variable (VL) domain comprising an LCDR1 amino acid sequence, an LCDR2 amino acid sequence, and an LCDR3 amino acid sequence as set forth in M0859 of Table 6; (m) an antibody heavy chain variable (VH) domain comprising an HCDR1 amino acid sequence, an HCDR2 amino acid sequence, and an HCDR3 amino acid sequence as set forth in M0860 of Table 6, and an antibody light chain variable (VL) domain comprising an LCDR1 amino acid sequence, an LCDR2 amino acid sequence, and an LCDR3 amino acid sequence as set forth in M0860 of Table 6; (n) an antibody heavy chain variable (VH) domain comprising an HCDR1 amino acid sequence, an HCDR2 amino acid sequence, and an HCDR3 amino acid sequence as set forth in M0861 of Table 6, and an antibody light chain variable (VL) domain comprising an LCDR1 amino acid sequence, an LCDR2 amino acid sequence, and an LCDR3 amino acid sequence as set forth in M0861 of Table 6; (o) an antibody heavy chain variable (VH) domain comprising an HCDR1 amino acid sequence, an HCDR2 amino acid sequence, and an HCDR3 amino acid sequence as set forth in M0862 of Table 6, and an antibody light chain variable (VL) domain comprising an LCDR1 amino acid sequence, an LCDR2 amino acid sequence, and an LCDR3 amino acid sequence as set forth in M0862 of Table 6; (p) an antibody heavy chain variable (VH) domain comprising an HCDR1 amino acid sequence, an HCDR2 amino acid sequence, and an HCDR3 amino acid sequence as set forth in M0863 of Table 6, and an antibody light chain variable (VL) domain comprising an LCDR1 amino acid sequence, an LCDR2 amino acid sequence, and an LCDR3 amino acid sequence as set forth in M0863 of Table 6; (q) an antibody heavy chain variable (VH) domain comprising an HCDR1 amino acid sequence, an HCDR2 amino acid sequence, and an HCDR3 amino acid sequence as set forth in M0864 of Table 6, and an antibody light chain variable (VL) domain comprising an LCDR1 amino acid sequence, an LCDR2 amino acid sequence, and an LCDR3 amino acid sequence as set forth in M0864 of Table 6; (r) an antibody heavy chain variable (VH) domain comprising an HCDR1 amino acid sequence, an HCDR2 amino acid sequence, and an HCDR3 amino acid sequence as set forth in M0865 of Table 6, and an antibody light chain variable (VL) domain comprising an LCDR1 amino acid sequence, an LCDR2 amino acid sequence, and an LCDR3 amino acid sequence as set forth in M0865 of Table 6; (s) an antibody heavy chain variable (VH) domain comprising an HCDR1 amino acid sequence, an HCDR2 amino acid sequence, and an HCDR3 amino acid sequence as set forth in M0866 of Table 6, and an antibody light chain variable (VL) domain comprising an LCDR1 amino acid sequence, an LCDR2 amino acid sequence, and an LCDR3 amino acid sequence as set forth in M0866 of Table 6; (t) an antibody heavy chain variable (VH) domain comprising an HCDR1 amino acid sequence, an HCDR2 amino acid sequence, and an HCDR3 amino acid sequence as set forth in M0700 of Table 6, and an antibody light chain variable (VL) domain comprising an LCDR1 amino acid sequence, an LCDR2 amino acid sequence, and an LCDR3 amino acid sequence as set forth in M0700 of Table 6; (u) an antibody heavy chain variable (VH) domain comprising an HCDR1 amino acid sequence, an HCDR2 amino acid sequence, and an HCDR3 amino acid sequence as set forth in M0701 of Table 6, and an antibody light chain variable (VL) domain comprising an LCDR1 amino acid sequence, an LCDR2 amino acid sequence, and an LCDR3 amino acid sequence as set forth in M0701 of Table 6; (v) an antibody heavy chain variable (VH) domain comprising an HCDR1 amino acid sequence, an HCDR2 amino acid sequence, and an HCDR3 amino acid sequence as set forth in M0702 of Table 6, and an antibody light chain variable (VL) domain comprising an LCDR1 amino acid sequence, an LCDR2 amino acid sequence, and an LCDR3 amino acid sequence as set forth in M0702 of Table 6; (w) an antibody heavy chain variable (VH) domain comprising an HCDR1 amino acid sequence, an HCDR2 amino acid sequence, and an HCDR3 amino acid sequence as set forth in M0703 of Table 6, and an antibody light chain variable (VL) domain comprising an LCDR1 amino acid sequence, an LCDR2 amino acid sequence, and an LCDR3 amino acid sequence as set forth in M0703 of Table 6; (x) an antibody heavy chain variable (VH) domain comprising an HCDR1 amino acid sequence, an HCDR2 amino acid sequence, and an HCDR3 amino acid sequence as set forth in M0704 of Table 6, and an antibody light chain variable (VL) domain comprising an LCDR1 amino acid sequence, an LCDR2 amino acid sequence, and an LCDR3 amino acid sequence as set forth in M0704 of Table 6; (y) an antibody heavy chain variable (VH) domain comprising an HCDR1 amino acid sequence, an HCDR2 amino acid sequence, and an HCDR3 amino acid sequence as set forth in M0705 of Table 6, and an antibody light chain variable (VL) domain comprising an LCDR1 amino acid sequence, an LCDR2 amino acid sequence, and an LCDR3 amino acid sequence as set forth in M0705 of Table 6; (z) an antibody heavy chain variable (VH) domain comprising an HCDR1 amino acid sequence, an HCDR2 amino acid sequence, and an HCDR3 amino acid sequence as set forth in M0706 of Table 6, and an antibody light chain variable (VL) domain comprising an LCDR1 amino acid sequence, an LCDR2 amino acid sequence, and an LCDR3 amino acid sequence as set forth in M0706 of Table 6; (aa) an antibody heavy chain variable (VH) domain comprising an HCDR1 amino acid sequence, an HCDR2 amino acid sequence, and an HCDR3 amino acid sequence as set forth in M0707 of Table 6, and an antibody light chain variable (VL) domain comprising an LCDR1 amino acid sequence, an LCDR2 amino acid sequence, and an LCDR3 amino acid sequence as set forth in M0707 of Table 6; (bb) an antibody heavy chain variable (VH) domain comprising an HCDR1 amino acid sequence, an HCDR2 amino acid sequence, and an HCDR3 amino acid sequence as set forth in M0708 of Table 6, and an antibody light chain variable (VL) domain comprising an LCDR1 amino acid sequence, an LCDR2 amino acid sequence, and an LCDR3 amino acid sequence as set forth in M0708 of Table 6; (cc) an antibody heavy chain variable (VH) domain comprising an HCDR1 amino acid sequence, an HCDR2 amino acid sequence, and an HCDR3 amino acid sequence as set forth in M0709 of Table 6, and an antibody light chain variable (VL) domain comprising an LCDR1 amino acid sequence, an LCDR2 amino acid sequence, and an LCDR3 amino acid sequence as set forth in M0709 of Table 6; (dd) an antibody heavy chain variable (VH) domain comprising an HCDR1 amino acid sequence, an HCDR2 amino acid sequence, and an HCDR3 amino acid sequence as set forth in M0710 of Table 6, and an antibody light chain variable (VL) domain comprising an LCDR1 amino acid sequence, an LCDR2 amino acid sequence, and an LCDR3 amino acid sequence as set forth in M0710 of Table 6; (ee) an antibody heavy chain variable (VH) domain comprising an HCDR1 amino acid sequence, an HCDR2 amino acid sequence, and an HCDR3 amino acid sequence as set forth in M0762 of Table 6, and an antibody light chain variable (VL) domain comprising an LCDR1 amino acid sequence, an LCDR2 amino acid sequence, and an LCDR3 amino acid sequence as set forth in M0762 of Table 6; (ff) an antibody heavy chain variable (VH) domain comprising an HCDR1 amino acid sequence, an HCDR2 amino acid sequence, and an HCDR3 amino acid sequence as set forth in M0763 of Table 6, and an antibody light chain variable (VL) domain comprising an LCDR1 amino acid sequence, an LCDR2 amino acid sequence, and an LCDR3 amino acid sequence as set forth in M0763 of Table 6; (gg) an antibody heavy chain variable (VH) domain comprising an HCDR1 amino acid sequence, an HCDR2 amino acid sequence, and an HCDR3 amino acid sequence as set forth in M0764 of Table 6, and an antibody light chain variable (VL) domain comprising an LCDR1 amino acid sequence, an LCDR2 amino acid sequence, and an LCDR3 amino acid sequence as set forth in M0764 of Table 6; (hh) an antibody heavy chain variable (VH) domain comprising an HCDR1 amino acid sequence, an HCDR2 amino acid sequence, and an HCDR3 amino acid sequence as set forth in M0765 of Table 6, and an antibody light chain variable (VL) domain comprising an LCDR1 amino acid sequence, an LCDR2 amino acid sequence, and an LCDR3 amino acid sequence as set forth in M0765 of Table 6; (ii) an antibody heavy chain variable (VH) domain comprising an HCDR1 amino acid sequence, an HCDR2 amino acid sequence, and an HCDR3 amino acid sequence as set forth in M0766 of Table 6, and an antibody light chain variable (VL) domain comprising an LCDR1 amino acid sequence, an LCDR2 amino acid sequence, and an LCDR3 amino acid sequence as set forth in M0766 of Table 6; (jj) an antibody heavy chain variable (VH) domain comprising an HCDR1 amino acid sequence, an HCDR2 amino acid sequence, and an HCDR3 amino acid sequence as set forth in M0767 of Table 6, and an antibody light chain variable (VL) domain comprising an LCDR1 amino acid sequence, an LCDR2 amino acid sequence, and an LCDR3 amino acid sequence as set forth in M0767 of Table 6; (kk) an antibody heavy chain variable (VH) domain comprising an HCDR1 amino acid sequence, an HCDR2 amino acid sequence, and an HCDR3 amino acid sequence as set forth in M0768 of Table 6, and an antibody light chain variable (VL) domain comprising an LCDR1 amino acid sequence, an LCDR2 amino acid sequence, and an LCDR3 amino acid sequence as set forth in M0768 of Table 6; or (ll) an antibody heavy chain variable (VH) domain comprising an HCDR1 amino acid sequence, an HCDR2 amino acid sequence, and an HCDR3 amino acid sequence as set forth in M0769 of Table 6, and an antibody light chain variable (VL) domain comprising an LCDR1 amino acid sequence, an LCDR2 amino acid sequence, and an LCDR3 amino acid sequence as set forth in M0769 of Table 6.

In certain embodiments, the antigen binding protein comprises: (a) an antibody heavy chain variable (VH) domain as set forth in M0848 of Table 6, and an antibody light chain variable (VL) domain as set forth in M0848 of Table 6; (b) an antibody heavy chain variable (VH) domain as set forth in M0849 of Table 6, and an antibody light chain variable (VL) domain as set forth in M0849 of Table 6; (c) an antibody heavy chain variable (VH) domain as set forth in M0850 of Table 6, and an antibody light chain variable (VL) domain as set forth in M0850 of Table 6; (d) an antibody heavy chain variable (VH) domain as set forth in M0851 of Table 6, and an antibody light chain variable (VL) domain as set forth in M0851 of Table 6; m(e) an antibody heavy chain variable (VH) domain as set forth in M0852 of Table 6, and an antibody light chain variable (VL) domain as set forth in M0852 of Table 6; (f) an antibody heavy chain variable (VH) domain as set forth in M0853 of Table 6, and an antibody light chain variable (VL) domain as set forth in M0853 of Table 6; (g) an antibody heavy chain variable (VH) domain as set forth in M0854 of Table 6, and an antibody light chain variable (VL) domain as set forth in M0854 of Table 6; (h) an antibody heavy chain variable (VH) domain as set forth in M0855 of Table 6, and an antibody light chain variable (VL) domain as set forth in M0855 of Table 6; (i) an antibody heavy chain variable (VH) domain as set forth in M0856 of Table 6, and an antibody light chain variable (VL) domain as set forth in M0856 of Table 6; (j) an antibody heavy chain variable (VH) domain as set forth in M0857 of Table 6, and an antibody light chain variable (VL) domain as set forth in M0857 of Table 6; (k) an antibody heavy chain variable (VH) domain as set forth in M0858 of Table 6, and an antibody light chain variable (VL) domain as set forth in M0858 of Table 6; (l) an antibody heavy chain variable (VH) domain as set forth in M0859 of Table 6, and an antibody light chain variable (VL) domain as set forth in M0859 of Table 6; (m) an antibody heavy chain variable (VH) domain as set forth in M0860 of Table 6, and an antibody light chain variable (VL) domain as set forth in M0860 of Table 6; (n) an antibody heavy chain variable (VH) domain as set forth in M0861 of Table 6, and an antibody light chain variable (VL) domain as set forth in M0861 of Table 6; (o) an antibody heavy chain variable (VH) domain as set forth in M0862 of Table 6, and an antibody light chain variable (VL) domain as set forth in M0862 of Table 6; (p) an antibody heavy chain variable (VH) domain as set forth in M0863 of Table 6, and an antibody light chain variable (VL) domain as set forth in M0863 of Table 6; (q) an antibody heavy chain variable (VH) domain as set forth in M0864 of Table 6, and an antibody light chain variable (VL) domain as set forth in M0864 of Table 6; (r) an antibody heavy chain variable (VH) domain as set forth in M0865 of Table 6, and an antibody light chain variable (VL) domain as set forth in M0865 of Table 6; (s) an antibody heavy chain variable (VH) domain as set forth in M0866 of Table 6, and an antibody light chain variable (VL) domain as set forth in M0866 of Table 6; (t) an antibody heavy chain variable (VH) domain as set forth in M0700 of Table 6, and an antibody light chain variable (VL) domain as set forth in M0700 of Table 6; (u) an antibody heavy chain variable (VH) domain as set forth in M0701 of Table 6, and an antibody light chain variable (VL) domain as set forth in M0701 of Table 6; (v) an antibody heavy chain variable (VH) domain as set forth in M0702 of Table 6, and an antibody light chain variable (VL) domain as set forth in M0702 of Table 6; (w) an antibody heavy chain variable (VH) domain as set forth in M0703 of Table 6, and an antibody light chain variable (VL) domain as set forth in M0703 of Table 6; (x) an antibody heavy chain variable (VH) domain as set forth in M0704 of Table 6, and an antibody light chain variable (VL) domain as set forth in M0704 of Table 6; (y) an antibody heavy chain variable (VH) domain as set forth in M0705 of Table 6, and an antibody light chain variable (VL) domain as set forth in M0705 of Table 6; (z) an antibody heavy chain variable (VH) domain as set forth in M0706 of Table 6, and an antibody light chain variable (VL) domain as set forth in M0706 of Table 6; (aa) an antibody heavy chain variable (VH) domain as set forth in M0707 of Table 6, and an antibody light chain variable (VL) domain as set forth in M0707 of Table 6; (bb) an antibody heavy chain variable (VH) domain as set forth in M0708 of Table 6, and an antibody light chain variable (VL) domain as set forth in M0708 of Table 6; (cc) an antibody heavy chain variable (VH) domain as set forth in M0709 of Table 6, and an antibody light chain variable (VL) domain as set forth in M0709 of Table 6; (dd) an antibody heavy chain variable (VH) domain as set forth in M0710 of Table 6, and an antibody light chain variable (VL) domain as set forth in M0710 of Table 6; (ee) an antibody heavy chain variable (VH) domain as set forth in M0762 of Table 6, and an antibody light chain variable (VL) domain as set forth in M0762 of Table 6; (ff) an antibody heavy chain variable (VH) domain as set forth in M0763 of Table 6, and an antibody light chain variable (VL) domain as set forth in M0763 of Table 6; (gg) an antibody heavy chain variable (VH) domain as set forth in M0764 of Table 6, and an antibody light chain variable (VL) domain as set forth in M0764 of Table 6; (hh) an antibody heavy chain variable (VH) domain as set forth in M0765 of Table 6, and an antibody light chain variable (VL) domain as set forth in M0765 of Table 6; (ii) an antibody heavy chain variable (VH) domain as set forth in M0766 of Table 6, and an antibody light chain variable (VL) domain as set forth in M0766 of Table 6; (jj) an antibody heavy chain variable (VH) domain as set forth in M0767 of Table 6, and an antibody light chain variable (VL) domain as set forth in M0767 of Table 6; (kk) an antibody heavy chain variable (VH) domain as set forth in M0768 of Table 6, and an antibody light chain variable (VL) domain as set forth in M0768 of Table 6; or (ll) an antibody heavy chain variable (VH) domain as set forth in M0769 of Table 6, and an antibody light chain variable (VL) domain as set forth in M0769 of Table 6.

In certain embodiments, the antigen binding protein comprises: (a) an antibody heavy chain variable (VH) domain comprising an HCDR1 amino acid sequence of SNYAMS (SEQ ID NO: 469), an HCDR2 amino acid sequence of IVSSGGTTYYAX$_1$X$_2$X$_3$KG (SEQ ID NO: 881), wherein X$_1$ corresponds to amino acid S or D, X$_2$ corresponds to amino acid W or S, and X$_3$ corresponds to amino acid A or V, and an HCDR3 amino acid sequence of DLYYGPX$_4$TX$_5$YX$_6$X$_7$X$_8$NL (SEQ ID NO: 882), wherein X$_4$ corresponds to amino acid T, N, or S, X$_5$ corresponds to amino acid D or is absent, X$_6$ corresponds to amino acid S or F, $X_7$ corresponds to amino acid A or V, and $X_8$ corresponds to amino acid F or A; and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATX$_9$X$_{10}$X$_{11}$SGSNFQX$_{12}$ (SEQ ID NO: 883), wherein $X_9$ corresponds to amino acid S or R, $X_{10}$ corresponds to amino acid D or P, $X_{11}$ corresponds to amino acid G, S, or F, and $X_{12}$ corresponds to amino acid L or A.

In certain embodiments, the antigen binding protein does not comprise: (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 470), and an HCDR3 amino acid sequence of DLYYGPTTYSAFNL (SEQ ID NO: 471); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATSDGSGSNFQL (SEQ ID NO: 474).

In certain embodiments, the antigen binding protein comprises: (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 657), and an HCDR3 amino acid sequence of DLYYGPSTYFVANL (SEQ ID NO: 731); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQL (SEQ ID NO: 879).

In certain embodiments, the antigen binding protein comprises: (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 653), and an HCDR3 amino acid sequence of DLYYGPTTYSAANL (SEQ ID NO: 727); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRDFSGSNFQL (SEQ ID NO: 875).

In certain embodiments, the antigen binding protein comprises: (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 658), and an HCDR3 amino acid sequence of DLYYGPNTDYSAANL (SEQ ID NO: 732); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQA (SEQ ID NO: 880).

In certain embodiments, the antigen binding protein comprises: (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 624), and an HCDR3 amino acid sequence of DLYYGPTTYSAFNL (SEQ ID NO: 698); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQA (SEQ ID NO: 846).

In certain embodiments, the antigen binding protein comprises: (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 470), and an HCDR3 amino acid sequence of DLYYGPTTYSAFNL (SEQ ID NO: 471); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATSDGSGSNFQL (SEQ ID NO: 474).

In certain embodiments, the antigen binding protein comprises: (a) an antibody heavy chain variable (VH) domain comprising a framework region, an HCDR1 region, an HCDR2 region, and an HCDR3 region, wherein the VH domain comprises an amino acid sequence set forth in SEQ ID NO: 575, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 575 and 100% identity to the HCDR1 region, HCDR2 region, and HCDR3 region set forth in SEQ ID NO: 575; and (b) an antibody light chain variable (VL) domain comprising a framework region, an LCDR1 region, an LCDR2 region, and an LCDR3 region, wherein the VL domain comprises an amino acid sequence set forth in SEQ ID NO: 797, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 797 and 100% identity to the LCDR1 region, LCDR2 region, and LCDR3 region set forth in SEQ ID NO: 797.

In certain embodiments, the antigen binding protein comprises: (a) an antibody heavy chain variable (VH) domain comprising a framework region, an HCDR1 region, an HCDR2 region, and an HCDR3 region, wherein the VH domain comprises an amino acid sequence set forth in SEQ ID NO: 583, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 583 and 100% identity to the HCDR1 region, HCDR2 region, and HCDR3 region set forth in SEQ ID NO: 583; and (b) an antibody light chain variable (VL) domain comprising a framework region, an LCDR1 region, an LCDR2 region, and an LCDR3 region, wherein the VL domain comprises an amino acid sequence set forth in SEQ ID NO: 805, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 805 and 100% identity to the LCDR1 region, LCDR2 region, and LCDR3 region set forth in SEQ ID NO: 805.

In certain embodiments, the antigen binding protein comprises: (a) an antibody heavy chain variable (VH) domain comprising a framework region, an HCDR1 region, an HCDR2 region, and an HCDR3 region, wherein the VH domain comprises an amino acid sequence set forth in SEQ ID NO: 579, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 579 and 100% identity to the HCDR1 region, HCDR2 region, and HCDR3 region set forth in SEQ ID NO: 579; and (b) an antibody light chain variable (VL) domain comprising a framework region, an LCDR1 region, an LCDR2 region, and an LCDR3 region, wherein the VL domain comprises an amino acid sequence set forth in SEQ ID NO: 801 or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 801 and 100% identity to the LCDR1 region, LCDR2 region, and LCDR3 region set forth in SEQ ID NO: 801.

In certain embodiments, the antigen binding protein comprises: (a) an antibody heavy chain variable (VH) domain comprising a framework region, an HCDR1 region, an HCDR2 region, and an HCDR3 region, wherein the VH domain comprises an amino acid sequence set forth in SEQ ID NO: 582, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 582 and 100% identity to the HCDR1 region, HCDR2 region, and HCDR3 region set forth in SEQ ID NO: 582; and (b) an antibody light chain variable (VL) domain comprising a framework region, an LCDR1 region, an LCDR2 region, and an LCDR3 region, wherein the VL domain comprises an amino acid sequence set forth in SEQ ID NO: 804 or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 804 and 100% identity to the LCDR1 region, LCDR2 region, and LCDR3 region set forth in SEQ ID NO: 804.

In certain embodiments, the antigen binding protein comprises: (a) an antibody heavy chain variable (VH) domain comprising a framework region, an HCDR1 region, an HCDR2 region, and an HCDR3 region, wherein the VH domain comprises an amino acid sequence set forth in SEQ ID NO: 584, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 584 and 100% identity to the HCDR1 region, HCDR2 region, and HCDR3 region set forth in SEQ ID NO: 584; and (b) an antibody light chain variable (VL) domain comprising a framework region, an LCDR1 region, an LCDR2 region, and an LCDR3 region, wherein the VL domain comprises an amino acid sequence set forth in SEQ ID NO: 806 or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 806 and 100% identity to the LCDR1 region, LCDR2 region, and LCDR3 region set forth in SEQ ID NO: 806.

In certain embodiments, the antigen binding protein comprises: (a) an antibody heavy chain variable (VH) domain comprising a framework region, an HCDR1 region, an HCDR2 region, and an HCDR3 region, wherein the VH domain comprises an amino acid sequence set forth in SEQ ID NO: 550, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 550 and 100% identity to the HCDR1 region, HCDR2 region, and HCDR3 region set forth in SEQ ID NO: 550; and (b) an antibody light chain variable (VL) domain comprising a framework region, an LCDR1 region, an LCDR2 region, and an LCDR3 region, wherein the VL domain comprises an amino acid sequence set forth in SEQ ID NO: 772 or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 772 and 100% identity to the LCDR1 region, LCDR2 region, and LCDR3 region set forth in SEQ ID NO: 772.

In certain embodiments, one or more of the HCDR1 amino acid sequence, the HCDR2 amino acid sequence, the HCDR3 amino acid sequence, the LCDR1 amino acid sequence, the LCDR2 amino acid sequence, and the LCDR3 amino acid sequence comprises one or more amino acid substitutions.

In certain embodiments, the antigen binding protein retains binding specificity to the target MAGE-A4 pMHC after the one or more amino acid substitutions.

In certain embodiments, one or more of the VH domain and the VL domain comprises one or more amino acid substitutions.

In certain embodiments, the antigen binding protein retains binding specificity to the target MAGE-A4 pMHC after the one or more amino acid substitutions.

In another aspect, the disclosure provides an antigen binding protein that specifically recognizes a target Melanoma-Associated Antigen A4 (MAGE-A4) peptide-MHC (pMHC), comprising: (a) an antibody heavy chain variable (VH) domain comprising an HCDR1 amino acid sequence of SNYAMS (SEQ ID NO: 469), an HCDR2 amino acid sequence of IVSSGGTTYYAX$_1$X$_2$X$_3$KG (SEQ ID NO: 881), wherein X$_1$ corresponds to amino acid S or D, X$_2$ corresponds to amino acid W or S, and X$_3$ corresponds to amino acid A or V, and an HCDR3 amino acid sequence of DLYYGPX$_4$TX$_5$YX$_6$X$_7$X$_8$NL (SEQ ID NO: 882), wherein X$_4$ corresponds to amino acid T, N, or S, X$_5$ corresponds to amino acid D or is absent, X$_6$ corresponds to amino acid S or F, X$_7$ corresponds to amino acid A or V, and X$_8$ corresponds to amino acid F or A; and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATX$_9$X$_{10}$X$_{11}$SGSNFQX$_{12}$ (SEQ ID NO: 883), wherein X$_9$ corresponds to amino acid S or R, X$_{10}$ corresponds to amino acid D or P, X$_{11}$ corresponds to amino acid G, S, or F, and X$_{12}$ corresponds to amino acid L or A.

In certain embodiments, the antigen binding protein does not comprise: (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 470), and an HCDR3 amino acid sequence of DLYYGPT-TYSAFNL (SEQ ID NO: 471); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATSDGSG-SNFQL (SEQ ID NO: 474).

In another aspect, the disclosure provides an antigen binding protein that specifically recognizes a target Melanoma-Associated Antigen A4 (MAGE-A4) peptide-MHC (pMHC), comprising: (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 657), and an HCDR3 amino acid sequence of DLYYGPSTYF-VANL (SEQ ID NO: 731); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSG-SNFQL (SEQ ID NO: 879).

In certain embodiments, the antigen binding protein comprises an antibody VH domain comprising an amino acid sequence of set forth in SEQ ID NO: 583 and an antibody VL domain comprising an amino acid sequence of set forth in SEQ ID NO: 805, or a VH domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 583 and a VL domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 805.

In another aspect, the disclosure provides an antigen binding protein that specifically recognizes a target Melanoma-Associated Antigen A4 (MAGE-A4) peptide-MHC (pMHC), comprising: (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 653), and an HCDR3 amino acid sequence of DLYYGPT-TYSAANL (SEQ ID NO: 727); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRDFSG-SNFQL (SEQ ID NO: 875).

In certain embodiments, the antigen binding protein comprises an antibody VH domain comprising an amino acid sequence of set forth in SEQ ID NO: 579 and an antibody VL domain comprising an amino acid sequence of set forth in SEQ ID NO: 801, or a VH domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 579 and a VL domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 801.

In another aspect, the disclosure provides an antigen binding protein that specifically recognizes a target Melanoma-Associated Antigen A4 (MAGE-A4) peptide-MHC (pMHC), comprising: (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 658), and an HCDR3 amino acid sequence of DLYYGPNTDYSAANL (SEQ ID NO: 732); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQA (SEQ ID NO: 880).

In certain embodiments, the antigen binding protein comprises an antibody VH domain comprising an amino acid sequence of set forth in SEQ ID NO: 584 and an antibody VL domain comprising an amino acid sequence of set forth in SEQ ID NO: 806, or a VH domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 584 and a VL domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 806

In another aspect, the disclosure provides an antigen binding protein that specifically recognizes a target Melanoma-Associated Antigen A4 (MAGE-A4) peptide-MHC (pMHC), comprising: (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 624), and an HCDR3 amino acid sequence of DLYYGPT-TYSAFNL (SEQ ID NO: 698); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSG-SNFQA (SEQ ID NO: 846).

In certain embodiments, the antigen binding protein comprises an antibody VH domain comprising an amino acid sequence of set forth in SEQ ID NO: 550 and an antibody VL domain comprising an amino acid sequence of set forth in SEQ ID NO: 772, or a VH domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 550 and a VL domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 772.

In certain embodiments, the antigen binding protein comprises one or more of the following characteristics: (i) the antigen binding protein comprises a binding affinity for the target MAGE-A4 pMHC of about $10^{-9}$ M to about $10^{-14}$ M; (ii) the antigen binding protein comprises a binding affinity for a non-MAGE-A4 pMHC and/or a peptide-free MHC of about $10^{-6}$ M or weaker; (iii) the antigen binding protein comprises a binding affinity for a non-target MAGE-A4 pMHC of about $10^{-6}$M or weaker; and (iv) the antigen binding protein comprises a binding affinity for the target MAGE-A4 pMHC of about $10^{-9}$ M to about $10^{-14}$ M, and a binding affinity for the MAGE-A4 peptide, an HLA polypeptide, and a beta-2-microglobuin polypeptide alone of about $10^{-6}$ M or weaker.

In certain embodiments, the antigen binding protein comprises specificity for a MAGE-A4 peptide amino acid sequence set forth in SEQ ID NO: 3 (GVYDGREHTV).

In certain embodiments, the VH domain and VL domain are attached with an amino acid linker. In certain embodiments, the amino acid linker comprises (GGGGS)n, wherein n is an integer between 1 and 5 (SEQ ID NO: 888). In certain embodiments, the amino acid linker comprises the amino acid sequence GGGGSGGGGSGGGGS (SEQ ID NO: 889), GGGGSGGGGSGGGGSGGGGS (SEQ ID NO: 890), or GGGGSGGGGSGGGGSGGGGAS (SEQ ID NO: 891).

In certain embodiments, the antigen binding protein comprises: (a) an antibody VHH domain comprising an HCDR1 amino acid sequence, an HCDR2 amino acid sequence, and an HCDR3 amino acid sequence as set forth in M0734 of Table 8; (b) an antibody VHH domain comprising an HCDR1 amino acid sequence, an HCDR2 amino acid sequence, and an HCDR3 amino acid sequence as set forth in M0735 of Table 8; (c) an antibody VHH domain comprising an HCDR1 amino acid sequence, an HCDR2 amino acid sequence, and an HCDR3 amino acid sequence as set forth in M0736 of Table 8; (d) an antibody VHH domain comprising an HCDR1 amino acid sequence, an HCDR2 amino acid sequence, and an HCDR3 amino acid sequence as set forth in M0737 of Table 8; (e) an antibody VHH domain comprising an HCDR1 amino acid sequence, an HCDR2 amino acid sequence, and an HCDR3 amino acid sequence as set forth in M0738 of Table 8; (f) an antibody VHH domain comprising an HCDR1 amino acid sequence, an HCDR2 amino acid sequence, and an HCDR3 amino acid sequence as set forth in M0739 of Table 8; (g) an antibody VHH domain comprising an HCDR1 amino acid sequence, an HCDR2 amino acid sequence, and an HCDR3 amino acid sequence as set forth in M0740 of Table 8; (h) an antibody VHH domain comprising an HCDR1 amino acid sequence, an HCDR2 amino acid sequence, and an HCDR3 amino acid sequence as set forth in M0741 of Table 8; (i) an antibody VHH domain comprising an HCDR1 amino acid sequence, an HCDR2 amino acid sequence, and an HCDR3 amino acid sequence as set forth in M0742 of Table 8; (j) an antibody VHH domain comprising an HCDR1 amino acid sequence, an HCDR2 amino acid sequence, and an HCDR3 amino acid sequence as set forth in M0743 of Table 8; (k) an antibody VHH domain comprising an HCDR1 amino acid sequence, an HCDR2 amino acid sequence, and an HCDR3 amino acid sequence as set forth in M0744 of Table 8; (l) an antibody VHH domain comprising an HCDR1 amino acid sequence, an HCDR2 amino acid sequence, and an HCDR3 amino acid sequence as set forth in M0745 of Table 8; (m) an antibody VHH domain comprising an HCDR1 amino acid sequence, an HCDR2 amino acid sequence, and an HCDR3 amino acid sequence as set forth in M0746 of Table 8; (n) an antibody VHH domain comprising an HCDR1 amino acid sequence, an HCDR2 amino acid sequence, and an HCDR3 amino acid sequence as set forth in M0747 of Table 8; (o) an antibody VHH domain comprising an HCDR1 amino acid sequence, an HCDR2 amino acid sequence, and an HCDR3 amino acid sequence as set forth in M0748 of Table 8; (p) an antibody VHH domain comprising an HCDR1 amino acid sequence, an HCDR2 amino acid sequence, and an HCDR3 amino acid sequence as set forth in M0749 of Table 8; (q) an antibody VHH domain comprising an HCDR1 amino acid sequence, an HCDR2 amino acid sequence, and an HCDR3 amino acid sequence as set forth in M0750 of Table 8; (r) an antibody VHH domain comprising an HCDR1 amino acid sequence, an HCDR2 amino acid sequence, and an HCDR3 amino acid sequence as set forth in M0751 of Table 8; or (s) an antibody VHH domain comprising an HCDR1 amino acid sequence, an HCDR2 amino acid sequence, and an HCDR3 amino acid sequence as set forth in M0752 of Table 8.

In certain embodiments, the antigen binding protein comprises: (a) an antibody VHH domain as set forth in M0734 of Table 8; (b) an antibody VHH domain as set forth in M0735 of Table 8; (c) an antibody VHH domain as set forth in M0736 of Table 8; (d) an antibody VHH domain as set forth in M0737 of Table 8; (e) an antibody VHH domain as set forth in M0738 of Table 8; (f) an antibody VHH domain as set forth in M0739 of Table 8; (g) an antibody VHH domain as set forth in M0740 of Table 8; (h) an antibody VHH domain as set forth in M0741 of Table 8; (i) an antibody VHH domain as set forth in M0742 of Table 8; (j) an antibody VHH domain as set forth in M0743 of Table 8; (k) an antibody VHH domain as set forth in M0744 of Table 8; (l) an antibody VHH domain as set forth in M0745 of Table 8; (m) an antibody VHH domain as set forth in M0746 of Table 8; (n) an antibody VHH domain as set forth in M0747 of Table 8; (o) an antibody VHH domain as set forth in M0748 of Table 8; (p) an antibody VHH domain as set forth in M0749 of Table 8; (q) an antibody VHH domain as set forth in M0750 of Table 8; (r) an antibody VHH domain as set forth in M0751 of Table 8; or (s) an antibody VHH domain as set forth in M0752 of Table 8.

In certain embodiments, one or more of the HCDR1 amino acid sequence, the HCDR2 amino acid sequence, and the HCDR3 amino acid sequence comprises one or more amino acid substitutions.

In certain embodiments, the antigen binding protein retains binding specificity to the target MAGE-A4 pMHC after the one or more amino acid substitutions.

In certain embodiments, the VHH domain comprises one or more amino acid substitutions.

In certain embodiments, the antigen binding protein retains binding specificity to the target MAGE-A4 pMHC after the one or more amino acid substitutions.

In certain embodiments, the antigen binding protein comprises a binding affinity for the MAGE-A4 pMHC of at least about $10^{-9}$ M.

In certain embodiments, the antigen binding protein comprises a binding affinity for the MAGE-A4 pMHC of about $10^{-9}$ M to about $10^{-9}$ M.

In certain embodiments, the antigen binding protein comprises a binding affinity for the MAGE-A4 pMHC of about $10^{-10}$ M to about $10^{-12}$ M.

In certain embodiments, the antigen binding protein lacks detectable binding affinity for a non-MAGE-A4 pMHC.

In certain embodiments, the antigen binding protein lacks detectable binding affinity for a peptide-free MHC.

In certain embodiments, the antigen binding protein lacks detectable binding affinity for a non-target MAGE-A4 pMHC.

In certain embodiments, the antigen binding protein lacks detectable binding affinity for MAGE-A4 peptide alone.

In certain embodiments, the antigen binding protein lacks detectable binding affinity for an HLA polypeptide alone.

In certain embodiments, the antigen binding protein lacks detectable binding affinity for a beta-2-microglobuin polypeptide alone.

In certain embodiments, the antigen binding protein specifically binds the MAGE-A4 pMHC on the surface of a cell.

In certain embodiments, the antigen binding protein lacks detectable binding affinity for a non-MAGE-A4 pMHC on the surface of a cell.

In certain embodiments, the antigen binding protein comprises cytotoxic activity against a MAGE-A4 pMHC-expressing cell.

In certain embodiments, the antigen binding protein lacks detectable cytotoxic activity against a non-MAGE-A4 pMHC-expressing cell.

In certain embodiments, the antigen binding protein is a humanized antigen binding protein.

In certain embodiments, the antigen binding protein is a human antigen binding protein.

In certain embodiments, the binding affinity is measured by surface plasmon resonance (SPR).

In one aspect, the disclosure provides a bispecific antigen binding protein, comprising a first antigen binding domain comprising the antigen binding protein recited above, and a second antigen binding domain with specificity for a cell surface protein of an immune cell.

In certain embodiments, the immune cell is selected from the group consisting of a T cell, a B cell, a natural killer (NK) cell, a natural killer T (NKT) cell, a neutrophil cell, a monocyte, and a macrophage.

In certain embodiments, the immune cell is a T cell.

In certain embodiments, the cell surface protein of an immune cell is selected from the group consisting of CD3, TCRα, TCRβ, CD16, NKG2D, CD89, CD64, and CD32.

In certain embodiments, the cell surface protein of an immune cell is CD3.

In certain embodiments, the first antigen binding domain comprises an scFv or VHH, and the second antigen binding domain comprises a Fab.

In certain embodiments, the bispecific antigen binding protein is multivalent.

In certain embodiments, the bispecific antigen binding protein comprises three antigen binding sites.

In certain embodiments, the bispecific antigen binding protein further comprises an immune checkpoint inhibitor.

In certain embodiments, the immune checkpoint inhibitor is selected from the group consisting of an anti-CTLA-4 antibody, an anti-PD-L1 antibody, an anti-PD-1 antibody, an anti-TIM-3 antibody, an anti-LAG-3 antibody, an anti-BTLA antibody, an anti-VISTA antibody, and combinations thereof.

In another aspect, the disclosure provides for the use of the antigen binding protein recited above, or the bispecific antigen binding protein recited above, for preparing a pharmaceutical composition for treating a MAGE-A4 associated cancer in a subject.

In another aspect, the disclosure provides a pharmaceutical composition comprising the antigen binding protein recited above, or the bispecific antigen binding protein recited above, and a pharmaceutically acceptable carrier.

In another aspect, the disclosure provides a method of treating a MAGE-A4 pMHC-expressing cancer in a patient in need thereof comprising administering to the patient a therapeutically effective amount of the pharmaceutical composition recited above.

In certain embodiments, the method further comprises administering an immune checkpoint inhibitor.

In certain embodiments, the immune checkpoint inhibitor is selected from the group consisting of an anti-CTLA-4 antibody, an anti-PD-L1 antibody, an anti-PD-1 antibody, an anti-TIM-3 antibody, an anti-LAG-3 antibody, an anti-BTLA antibody, an anti-VISTA antibody, and combinations thereof.

In another aspect, the disclosure provides a nucleic acid encoding the antigen binding protein recited above, or the bispecific antigen binding protein recited above.

In another aspect, the disclosure provides an expression vector comprising the nucleic acid recited above.

In another aspect, the disclosure provides a host cell comprising the expression vector recited above.

In another aspect, the disclosure provides a method of manufacturing the antigen binding protein recited above, or the bispecific antigen binding protein recited above, comprising the steps of: (i) cultivating the host cell recited above under conditions allowing expression of the antigen binding protein or the bispecific antigen binding protein; (ii) recovering the antigen binding protein or bispecific antigen binding protein; and optionally (iii) further purifying and/or modifying and/or formulating the antigen binding protein or bispecific antigen binding protein.

BRIEF DESCRIPTION OF THE DRAWINGS

The foregoing and other features and advantages of the present invention will be more fully understood from the following detailed description of illustrative embodiments taken in conjunction with the accompanying drawings. The patent or application file contains at least one drawing executed in color. Copies of this patent or patent application publication with color drawing(s) will be provided by the Office upon request and payment of the necessary fee.

FIG. 1 discloses SEQ ID NOS 903-916, 915, 917, 912, 918, 912, 919, 915, 920-921, 914, 911, 915, 914, 922, 910, 914, 911, 914, 921, 910, 923, 920, 924, 913, 910, 912, 925-928, 912, 914, 929-930, 915, 914, 914, 914-915, 910, 914, 931-932, 912, 912, 912, 933, 914, 914, 934, 914, 914, and 914, respectively, in order of appearance.

FIG. 2 depicts the DNA sequence alignment of the randomly selected control antibodies from a rabbit immune library which have been used to qualify the designed primer set by identifying mismatches. The relevant cysteine is marked with an asterisk. FIG. 2 discloses SEQ ID NOS 935-953 and 893, respectively, in order of appearance.

DETAILED DESCRIPTION

Figure 1:
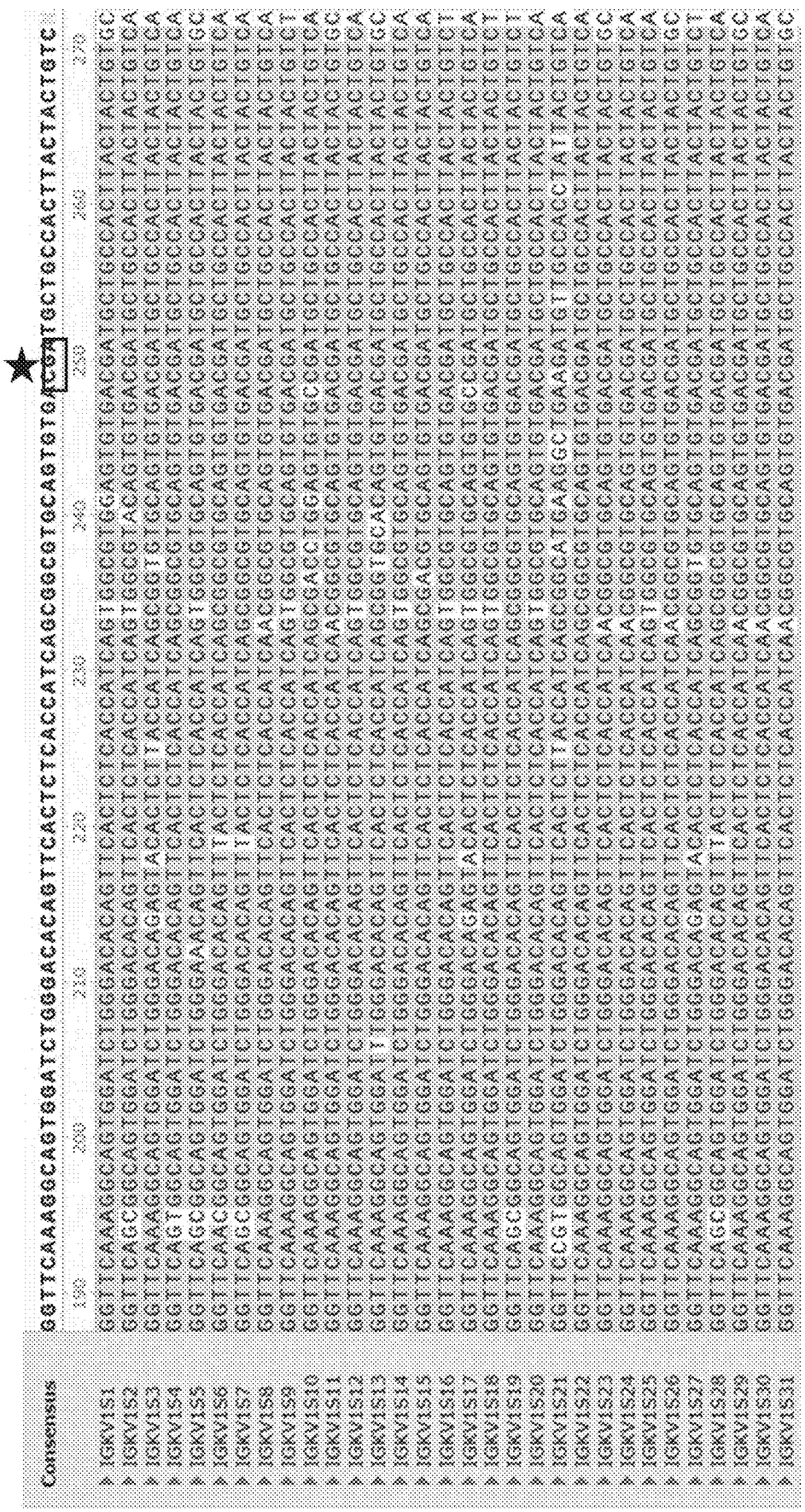
FIG. 1 depicts the DNA sequence alignment of the rabbit kappa light chain sequences of all 68 alleles retrieved from the IMGT database. The flanking regions around the codon coding for relevant cysteine 80 (marked with an asterisk) show a high sequence conservation.

Generally, nomenclature used in connection with cell and tissue culture, molecular biology, immunology, microbiology, genetics and protein and nucleic acid chemistry and hybridization described herein is well-known and commonly used in the art. The methods and techniques provided herein are generally performed according to conventional methods well known in the art and as described in various general and more specific references that are cited and discussed throughout the present specification unless otherwise indicated. Enzymatic reactions and purification techniques are performed according to manufacturer's specifications, as commonly accomplished in the art or as described herein. The nomenclature used in connection with, and the laboratory procedures and techniques of, analytical chemistry, synthetic organic chemistry, and medicinal and pharmaceutical chemistry described herein is well-known and commonly used in the art. Standard techniques are used for chemical syntheses, chemical analyses, pharmaceutical preparation, formulation, and delivery, and treatment of patients.

Unless otherwise defined herein, scientific and technical terms used herein have the meanings that are commonly understood by those of ordinary skill in the art. In the event of any latent ambiguity, definitions provided herein take precedent over any dictionary or extrinsic definition. Unless otherwise required by context, singular terms shall include pluralities and plural terms shall include the singular. The use of "or" means "and/or" unless stated otherwise. The use of the term "including," as well as other forms, such as "includes" and "included," is not limiting.

So that the invention may be more readily understood, certain terms are first defined.

Antigen Binding Proteins

As used herein, the term "antibody" or "antigen binding protein" refers to an immunoglobulin molecule or immunoglobulin derived molecule that specifically binds to, or is immunologically reactive with an antigen or epitope, and includes both polyclonal and monoclonal antibodies, as well as functional antibody fragments, including but not limited to fragment antigen-binding (Fab) fragments, F(ab')$_2$ fragments, Fab' fragments, FAT fragments, recombinant IgG (rIgG) fragments, single chain variable fragments (scFv) and single domain antibodies (e.g., sdAb, sdFv, nanobody, VHH) fragments. The antibody may thus be a single domain antibody or comprise at least one variable light and at least one variable heavy chain. In one embodiment, the at least one variable light and at least one variable heavy chain are displayed as a single polypeptide chain. The term "antibody" or "antigen binding protein" includes germline derived antibodies. The term "antibody" or "antigen binding protein" includes genetically engineered or otherwise modified forms of immunoglobulins, such as intrabodies, peptibodies, chimeric antibodies, fully human antibodies, humanized antibodies, heteroconjugate antibodies (e.g., bispecific antibodies, diabodies, triabodies, tetrabodies, tandem di-scFv, tandem tri-scFv) and the like. Unless otherwise stated, the term "antibody" or "antigen binding protein" should be understood to encompass functional antibody fragments thereof.

In certain embodiments, the antigen binding protein is not a T cell receptor (TCR), including but not limited to, a soluble TCR.

In certain embodiments, the antigen binding protein is multispecific (i.e., binds to two or more different target molecules or to two or more epitopes on the same target molecule). In certain embodiments, the antigen binding protein is bispecific and e.g., binds to two different target molecules or to two epitopes on the same target molecule. In certain embodiments, the antibody is trispecific and e.g., binds to at least three different target molecules.

The antigen binding protein may be monovalent or multivalent, i.e., having one or more antigen binding sites. Non-limiting examples of monovalent antigen binding proteins include scFv, Fab, scFab, dAb, VHH, V(NAR), DARPins, affilins and nanobodies. A multivalent antigen binding protein can have two, three, four or more antigen binding sites. Non-limiting examples of multivalent antigen binding proteins include full-length immunoglobulins, F(ab')2fragments, bis-scFv (or tandem scFvor BiTE), DART, diabodies, scDb, DVD-Ig, IgG-scFab, scFab-Fc-scFab, IgG-scFv, scFv-Fc, scFv-fc-scFv, Fv2-Fc, FynomABs, quadroma, CrossMab, DuoBody, triabodies and tetrabodies. In some embodiments, the multivalent antigen binding protein is bivalent, i.e., two binding sites are present. In some embodiments, the multivalent antigen binding protein is bispecific, i.e., the antigen binding protein is directed against two different targets or two different target sites on one target molecule. In some embodiments, the multivalent antigen binding protein includes more than two, e.g., three or four different binding sites for three or four, respectively, different antigens. Such antigen binding protein is multivalent and multispecific, in particular tri- or tetra-specific, respectively.

In some embodiments, the antigen binding proteins are multispecific (e.g., bispecific), such as, without being limited to, diabodies, single-chain diabodies, DARTs, BiTEs, tandem scFvs or IgG-like asymmetric heterobispecific antibodies. In certain embodiments, one or the binding specificities of the multispecific antigen binding protein is an immune cell engager (i.e., comprising binding affinity to a cell surface protein of an immune cell). Examples of immune cells that may be recruited include, but are not limited to, T cells, B cells, natural killer (NK) cells, natural killer T (NKT) cells, neutrophil cells, monocytes, and macrophages. Examples of surface proteins that may be used to recruit immune cells includes, but are limited to, CD3, TCRα, TCRβ, CD16, NKG2D, CD89, CD64, and CD32. Such immune cell redirecting multispecific antigen binding proteins may in some embodiments comprise a Fc domain.

In certain embodiments, the immune cell target antigen is CD3. An exemplary CD3 antigen binding domain is recited below in Table 7 and in WO2016086196 and WO2017201493, incorporated herein by reference.

As used herein, a "single-chain variable fragment" (scFv) is an antigen binding protein comprising a heavy chain variable domain (VH) linked to a light chain variable domain (VL). The VH and VL domains of the scFv are linked via any appropriate art recognized linker. Such linkers include, but are not limited to, repeated GGGGS (SEQ ID NO: 188) amino acid sequences or variants thereof. The scFv is generally free of antibody constant domain regions, although an scFv of the disclosure may be linked or attached to antibody constant domain regions (e.g., antibody Fc domain) to alter various properties of the scFv, including, but not limited to, increased serum or tissue half-life. An scFv generally has a molecular weight of about 25 kDa and a hydrodynamic radius of about 2.5 nm.

As used herein, a "Fab fragment" or "Fab" is an antibody fragment comprising a light chain fragment comprising a variable light (VL) domain and a constant domain of the light chain (CL), and variable heavy (VH) domain and a first constant domain (CH1) of the heavy chain.

As used herein, a "VHH", "nanobody", or "heavy-chain only antibody" is an antigen binding protein comprising a single heavy chain variable domain derived from the species of the Camelidae family, which includes camels, llama, alpaca. A VHH generally has a molecular weight of about 15 kDa.

In one embodiment, the antigen binding protein comprises an Fc domain. The presence of an Fc domain may be advantageous to induce cytotoxic immune responses and/or activate complement (e.g., ADCC/ADCP or CDC effector function). Exemplary antibody formats including an Fc domain, without being limited to, are full-length immunoglobulins, DVD-Ig, scFv-Fc and scFv-Fc. scFv fusions, IgG-scFab, scFab-dsscFv, Fv2-Fc, IgG-scFv fusions (such as e.g., bsAb, Bs1Ab, Bs2Ab, Bs3Ab, Ts1Ab, Ts2Ab, Knob-into-Holes (KiHs)), DuoBody and/or CrossMabs. An active Fc domain may increase the likelihood of pro-inflammatory cytokine release by T cells and other effector cells in the tumor microenvironment which is believed to be part of the therapeutic mechanism of action. The Fc domain may be fully active or partly silenced to avoid over-stimulation of the immune system. In some embodiments, the Fc domain is inactive and does not stimulate pro-inflammatory cytokine release but does still improve half-life and/or stability of the antigen binding protein. In some embodiments, the antigen binding protein comprises a constant region selected from the group consisting of human IgG1, IgG2, IgG3 or IgG4 isotype. In other embodiments, the antigen binding protein comprises a constant region selected from the group consisting of murine IgG1, IgG2A, IgG2B or IgG3 isotype.

The antigen binding proteins of the disclosure may comprise one or more linkers for linking the domains of the antigen binding protein (e.g., linking a VH and VL to form a scFv, or linking multiple binding domains to form a multispecific antigen binding protein).

Illustrative examples of linkers include glycine polymers $(Gly)_n$ (SEQ ID NO: 954); glycine-serine polymers $(Gly_nSer)_n$ (SEQ ID NO: 892), where n is an integer of at least one, two, three, four, five, six, seven, or eight; glycine-alanine polymers; alanine-serine polymers; and other flexible linkers known in the art.

Glycine and glycine-serine polymers are relatively unstructured, and therefore may be able to serve as a neutral tether between domains of fusion proteins such as the antigen binding proteins described herein. Glycine accesses significantly more phi-psi space than other small side chain amino acids, and is much less restricted than residues with longer side chains (Scheraga, Rev. Computational Chem. 1: 1173-142 (1992)). A person skilled in the art will recognize that design of a antigen binding protein in particular embodiments can include linkers that are all or partially flexible, such that the linker can include flexible linker stretches as well as one or more stretches that confer less flexibility to provide a desired structure.

Linker sequences can however be chosen to resemble natural linker sequences, for example, using the amino acid stretches corresponding to the beginning of human CH1 and Cκ sequences or amino acid stretches corresponding to the lower portion of the hinge region of human IgG.

The design of the peptide linkers connecting VL and VH domains in the scFv moieties are flexible linkers generally composed of small, non-polar or polar residues such as, e.g., Gly, Ser and Thr. A particularly exemplary linker connecting the variable domains of the scFv moieties is the $(Gly_4Ser)_4$ linker (SEQ ID NO: 890), where 4 is the exemplary number of repeats of the motif.

Other exemplary linkers include, but are not limited to the following amino acid sequences: GGG; DGGGS (SEQ ID NO: 894); TGEKP (SEQ ID NO: 895) (Liu et al, Proc. Natl. Acad. Sci. 94: 5525-5530 (1997)); GGRR (SEQ ID NO: 896); $(GGGGS)_n$ (SEQ ID NO: 888) wherein n=1, 2, 3, 4 or 5 (Kim et al, Proc. Natl. Acad. Sci. 93: 1156-1160 (1996)); EGKSSGSGSESKVD (SEQ ID NO: 897) (Chaudhary et al., Proc. Natl. Acad. Sci. 87: 1066-1070 (1990)); KESGSVSSEQLAQFRSLD (SEQ ID NO: 898) (Bird et al., Science 242:423-426 (1988)), GGRRGGGS (SEQ ID NO: 899); LRQRDGERP (SEQ ID NO: 900); LRQKDGGGSERP (SEQ ID NO: 901); and GST-SGSGKPGSGEGSTKG (SEQ ID NO: 902) (Cooper et al, Blood, 101(4): 1637-1644 (2003)). Alternatively, flexible linkers can be rationally designed using a computer program capable of modeling the 3D structure of proteins and peptides or by phage display methods.

The antibodies may comprise a variable light (VL) domain and a variable heavy (VH) domain. Each VL and VH domain further comprises a set of three CDRs.

As used herein, the term "complementarity determining region" or "CDR" refers to non-contiguous sequences of amino acids within antibody variable regions, which confer antigen specificity and binding affinity. In general, there are three CDRs in each heavy chain variable domain (CDRH1, CDRH2, CDRH3) and three CDRs in each light chain variable domain (CDRL1, CDRL2, CDRL3). "Framework regions" or "FRs" are known in the art to refer to the non-CDR portions of the variable domains of the heavy and light chains. In general, there are four FRs in each heavy chain variable domain (HFR1, HFR2, HFR3, and HFR4), and four FRs in each light chain variable domain (LFR1, LFR2, LFR3, and LFR4). Accordingly, an antibody variable region amino acid sequence can be represented by the formula FR1-CDR1-FR2-CDR2-FR3-CDR3-FR4. Each segment of the formula, i.e., FR1, CDR1, FR2, CDR2, FR3, CDR3, and FR4, represents a discrete amino acid sequence (or a polynucleotide sequence encoding the same) that can be mutated, including one or more amino acid substitutions, deletions, and insertions. In certain embodiments, an antibody variable light chain amino acid sequence can be represented by the formula LFR1-CDRL1-LFR2-CDRL2-LFR3-CDRL3-LFR4. In certain embodiments, an antibody variable heavy chain amino acid sequence can be represented by the formula HFR1-CDRH1-HFR2-CDRH2-HFR3-CDRH3-HFR4.

In certain embodiments, one or more CDR amino acid sequences of the disclosure comprises one or more amino acid substitutions (e.g., 1, 2, 3, 4, 5, or more amino acid substitutions).

In certain embodiments, one or more framework region amino acid sequences of the disclosure comprises one or more amino acid substitutions (e.g., 1, 2, 3, 4, 5, 6, 7, 8, 9, 10, 11, 12, 13, 14, 15, 16, 17, 18, 19, 20, or more amino acid substitutions).

The precise amino acid sequence boundaries of a given CDR or FR can be readily determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273, 927-948 ("Chothia" numbering scheme), MacCallum et al., J. Mol. Biol. 262: 732-745 (1996), "Antibody-antigen interactions: Contact analysis and binding site topography," J. Mol. Biol. 262, 732-745. ("Contact" numbering scheme), Lefranc M P et al., "IMGT unique numbering for immunoglobulin and T cell receptor variable domains and Ig superfamily V-like domains," Dev Comp Immunol, 2003 January; 27(1):55-77 ("IMGT" numbering scheme), and Honegger A and Pluckthun A, "Yet another numbering scheme for immunoglobulin variable domains: an automatic modeling and analysis tool," J Mol Biol, 2001 Jun. 8; 309(3):657-70, ("AHo" numbering scheme).

The boundaries of a given CDR or FR may vary depending on the scheme used for identification. For example, the Kabat scheme is based structural alignments, while the Chothia scheme is based on structural information. Numbering for both the Kabat and Chothia schemes is based upon the most common antibody region sequence lengths, with insertions accommodated by insertion letters, for example, "30a," and deletions appearing in some antibodies. The two schemes place certain insertions and deletions ("indels") at different positions, resulting in differential numbering. The Contact scheme is based on analysis of complex crystal structures and is similar in many respects to the Chothia numbering scheme.

Table 1, below, lists exemplary position boundaries of CDRL1, CDRL2, CDRL3 and CDRH1, CDRH2, CDRH3 of an antibody, as identified by Kabat, Chothia, and Contact schemes, respectively. For CDRH1, residue numbering is listed using both the Kabat and Chothia numbering schemes. CDRs are located between FRs, for example, with CDRL1 located between LFR1 and LFR2, and so forth. It is noted that because the shown Kabat numbering scheme places insertions at H35A and H35B, the end of the Chothia CDRH1 loop when numbered using the shown Kabat numbering convention varies between H32 and H34, depending on the length of the loop.

TABLE 1

Exemplary Position Boundaries of CDRs

| CDR | Kabat | Chothia | Contact |
|---|---|---|---|
| LCDR1 | L24 - - - L34 | L24 - - - L34 | L30 - - - L36 |
| LCDR2 | L50 - - - L56 | L50 - - - L56 | L46 - - - L55 |
| LCDR3 | L89 - - - L97 | L89 - - - L97 | L89 - - - L96 |
| HCDR1 (Kabat Numbering[1]) | H31 - - - H35B | H26 - - - H32 . . . 34 | H30 - - - H35B |
| HCDR1 (Chothia Numbering[2]) | H31 - - - H35 | H26 - - - H32 | H30 - - - H35 |
| HCDR2 | H50 - - - H65 | H52 - - - H56 | H47 - - - H58 |
| HCDR3 | H95 - - - H102 | H95 - - - H102 | H93 - - - H101 |

[1]Kabat et al. (1991), "Sequences of Proteins of Immunological Interest," 5th Ed. Public Health Service, National Institutes of Health, Bethesda, MD
[2]Al-Lazikani et al. (1997), J. Mol. Biol. 273:927-948

Thus, unless otherwise specified, a "CDR" or "complementary determining region," or individual specified CDRs (e.g., CDRH1, CDRH2), of a given antibody or fragment thereof, such as a variable domain thereof, should be understood to encompass a (or the specific) complementary determining region as defined by any of the known schemes. Likewise, unless otherwise specified, an "FR" or "framework region," or individual specified FRs (e.g., "HFR1," "HFR2") of a given antibody or fragment thereof, such as a variable domain thereof, should be understood to encompass a (or the specific) framework region as defined by any of the known schemes. In some instances, the scheme for identification of a particular CDR or FR is specified, such as the CDR as defined by the Kabat, Chothia, or Contact method. In other cases, the particular amino acid sequence of a CDR or FR is given.

In certain embodiments, the rabbit antigen binding proteins disclosed here are humanized. As used herein, the term "humanized" or "humanization" refers to an antigen binding protein that has been altered to make it more like a human antibody. Non-human antigen binding proteins, such as the rabbit antigen binding proteins encoded in the nucleic acid libraries disclosed herein, would elicit a negative immune reaction if administered to a human for therapy. It is therefore advantageous to humanize the rabbit antigen binding proteins for later therapeutic use.

In certain embodiments, the antigen binding proteins are humanized through resurfacing (i.e., remodel the solvent-accessible residues of the non-human framework such that they become more human-like). Resurfacing strategies are described in more detail in WO2004/016740, WO2008/144757, and WO2005/016950, each of which is incorporated herein by reference.

In certain embodiments, the antigen binding proteins are humanized through CDR grafting (i.e., inserting the rabbit antigen binding protein CDRs into a human antibody acceptor framework). Grafting strategies and human acceptor frameworks are described in more detail in WO2009/155726, incorporated herein by reference.

As used herein, the term "affinity" refers to the strength of the interaction between an antibody's antigen binding site and the epitope to which it binds. As readily understood by those skilled in the art, an antibody or antigen binding protein affinity may be reported as a dissociation constant (KD) in molarity (M). The antibodies of the disclosure may have KD values in the range of $10^{-8}$ to $10^{-14}$M. High affinity antibodies have KD values of $10^{-9}$ M (1 nanomolar, nM) and lower. For example, a high affinity antibody may have a KD value in the range of about 1 nM to about 0.01 nM. A high affinity antibody may have KD value of about 1 nM, about 0.9 nM, about 0.8 nM, about 0.7 nM, about 0.6 nM, about 0.5 nM, about 0.4 nM, about 0.3 nM, about 0.2 nM, or about 0.1 nM. Very high affinity antibodies have KD values of $10^{-12}$ M (1 picomolar, pM) and lower. Weak, or low, affinity antibodies may have KD values in the range of $10^{-1}$ to $10^{-4}$ M. Low affinity antibodies may have KD values of $10^{-4}$ M and higher, such as $10^{-4}$ M, $10^{-3}$ M, $10^{-2}$ M, or $10^{-1}$ M.

The ability of an antibody to bind to a specific antigenic determinant (e.g., a target peptide-MHC) can be measured either through an enzyme-linked immunosorbent assay (ELISA) or other techniques familiar to one of skill in the art, e.g., surface plasmon resonance (SPR) technique (analyzed on a BIAcore instrument, for example) (Liljeblad et al., Glyco J 17, 323-329 (2000)), and traditional binding assays (Heeley, Endocr Res 28, 217-229 (2002)).

As used herein, the term "T cell receptor" or "TCR" refers to a heterodimeric protein comprised of two different chains (TCRα and TCRβ), which structurally belong to the immunoglobulin (Ig) superfamily. The extracellular portion of each chain is composed of variable ("Vα" and "Vβ") and constant ("Cα" and "Cβ") domains, and a hinge region, where the formation of a stabilizing disulfide bond occurs. The intracellular region forms a non-covalent interaction with another trans-membrane protein, CD3, which in the case of the correct target recognition leads to a series of conformational changes and a first T cell activation signal. Recognition and binding of peptide-MHC (pMHC) by a TCR is governed by the six hypervariable loops, termed complementarity determining regions (CDRs), located on the variable domains of the TCRα (CDRα1, CDRα2, CDRα3) and TCRβ (CDRβ1, CDRβ2, CDRβ3). CDR3 loops (CDRα3 and CDRβ3) lead the recognition of the processed antigen with the support of CDRα1 and CDRβ1, that have been implicated in the recognition of the N- and C-terminal amino acids of the presented peptide, respectively (Rudolph et al. Annu Rev Immunol. 24:419-66. 2006). Recognition of the MHC is typically achieved through the interaction with CDRα2 and CDRβ2. The high sequence diversity of the TCR is achieved through V(D)J recombination process, in which the variable domain is generated from a combination of genes: V (variable) and J (joining) for both TCRα and TCRβ, and an additional D (diversity) gene for TCRβ. The high antigen specificity of the TCR is controlled by the thymic maturation process, in which the self-reacting T cells are negatively selected. TCR affinity towards the specific pMHC and the functional avidity are the key factors controlling T-cell activation. A critical role in antigen recognition, however, is played by the affinity, i.e., the strength of binding between the TCR and the cell-displayed pMHC (Tian et al. J Immunol. 179:2952-2960. 2007). The physiological affinities of TCRs range from 1 μM to 100 μM (Davis et al. Annu Rev Immunol. 16:523-544. 1998), which, in comparison to antibodies, is relatively low.

As used herein, the term "peptide-MHC" refers to a major histocompatibility complex (MHC) molecule (MHC-I or -II) with an antigenic peptide bound in a peptide binding pocket of the MHC. In certain embodiments, the MHC is a human MHC.

MAGE-A4 pMHC Antigen Binding Proteins

Described herein are antigen binding proteins that specifically recognize a target Melanoma-Associated Antigen A4 (MAGE-A4) peptide-MHC (pMHC). The antigen binding proteins possess surprisingly high binding affinity while retaining high specificity for the target (i.e., low to no binding affinity for other targets, including non-MAGE-A4 pMHC, HLA polypeptides alone, or beta-2-microglobin alone).

In one aspect, the disclosure provides an antigen binding protein that specifically recognizes a target Melanoma-Associated Antigen A4 (MAGE-A4) peptide-MHC (pMHC), wherein the antigen binding protein comprises one or more of the following characteristics:
  (i) the antigen binding protein comprises a binding affinity for the target MAGE-A4 pMHC of about $10^{-9}$ M to about $10^{-14}$ (e.g., about $10^{-9}$ M, $10^{-10}$ M, $10^{-11}$ M, $10^{-12}$ M, $10^{-13}$ M, or $10^{-14}$ M);
  (ii) the antigen binding protein comprises a binding affinity for a non-MAGE-A4 peptide-MHC and/or a peptide-free MHC of about $10^{-6}$ M or weaker (e.g., about $10^{-6}$ M, $10^{-5}$ M, $10^{-4}$ M, $10^{-3}$M, $10^{-2}$ M, or $10^{-1}$ M);
  (iii) the antigen binding protein comprises a binding affinity for a non-target MAGE-A4 pMHC of about $10^{-6}$ M or weaker (e.g., about $10^{-6}$ M, $10^{-5}$ M, $10^{-4}$ M, $10^{-3}$ M, $10^{-2}$ M, or $10^{-1}$ M); and
  (iv) the antigen binding protein binds comprises a binding affinity for the target MAGE-A4 pMHC of about $10^{-9}$M to about $10^{-14}$ (e.g., about $10^{-9}$ M, $10^{-10}$ M, $10^{-11}$ M, $10^{-12}$ M, $10^{-13}$ M, or $10^{-14}$ M), and a binding affinity for the MAGE-A4 peptide, an HLA polypeptide, and a beta-2-microglobuin polypeptide alone of about $10^{-6}$ M or weaker (e.g., about $10^{-6}$ M, $10^{-5}$ M, $10^{-4}$ M, $10^{-3}$ M, $10^{-2}$ M, or $10^{-1}$ M).

In certain embodiments, the non-MAGE-A4 peptide-MHC comprises less than about 60% sequence identity with a MAGE-A4 polypeptide.

In certain embodiments, the non-MAGE-A4 peptide-MHC comprises about 80% sequence identity with a MAGE-A4 polypeptide.

In certain embodiments, the antigen binding protein is isolated (i.e., the antigen binding protein is not associated or bound to the surface of a cell, such as a T cell). In certain embodiments, the antigen binding protein is not a soluble TCR (e.g., a TCR lacking one or more of a transmembrane domain, an intracellular signaling domain, and constant domains).

In certain embodiments, the antigen binding protein comprises specificity for a MAGE-A4 peptide amino acid sequence set forth in SEQ ID NO: 3 (GVYDGREHTV).

In certain embodiments, the MAGE-A4 peptide is in complex with an HLA-A2 polypeptide.

In certain embodiments, the HLA-A2 polypeptide comprises the amino acid sequence set forth in SEQ ID NO: 1.

In certain embodiments, the beta-2-microglobuin polypeptide comprises the amino acid sequence set forth in SEQ ID NO: 2.

In certain embodiments, the antigen binding protein lacks detectable binding affinity for a MAGE-A4 peptide comprising one or more mutations (e.g., substitutions, deletions, and/or insertions) in the amino acid sequence set forth in SEQ ID NO: 3 (GVYDGREHTV).

In certain embodiments, the antigen binding protein lacks detectable binding affinity for a MAGE-A4 peptide comprising one, two, three, four, or five mutations (e.g., substitutions, deletions, and/or insertions) in the amino acid sequence set forth in SEQ ID NO: 3 (GVYDGREHTV).

In certain embodiments, the antigen binding protein lacks detectable binding affinity for a MAGE-A4 peptide comprising the amino acid sequence set forth in one or more of SEQ ID NO: 394 (GLADGRTHTV), SEQ ID NO: 395 (GLYDGPVHEV), and SEQ ID NO: 396 (GVFDGLHTV).

In certain embodiments, the antigen binding protein lacks detectable binding affinity for a MAGE-A4 peptide comprising the amino acid sequence set forth in SEQ ID NO: 394 (GLADGRTHTV), SEQ ID NO: 395 (GLYDGPVHEV), and SEQ ID NO: 396 (GVFDGLHTV).

In certain embodiments, the antigen binding protein comprises a binding affinity for a MAGE-A4 peptide comprising one or more mutations (e.g., substitutions, deletions, and/or insertions) in the amino acid sequence set forth in SEQ ID NO: 3 (GVYDGREHTV), of about $10^{-6}$ M or weaker (e.g., about $10^{-6}$M, $10^{-5}$M, $10^{-4}$ M, $10^{-3}$M, $10^{-2}$ M, or $10^{-1}$ M).

In certain embodiments, the antigen binding protein comprises a binding affinity for a MAGE-A4 peptide comprising one, two, three, four, or five mutations (e.g., substitutions, deletions, and/or insertions) in the amino acid sequence set forth in SEQ ID NO: 3 (GVYDGREHTV), of about $10^{-6}$ M or weaker (e.g., about $10^{-6}$ M, $10^{-5}$ M, $10^{-4}$ M, $10^{-3}$ M, $10^{-2}$ M, or $10^{-1}$ M).

In certain embodiments, the antigen binding protein comprises a binding affinity for a MAGE-A4 peptide comprising the amino acid sequence set forth in one or more of SEQ ID NO: 394 (GLADGRTHTV), SEQ ID NO: 395 (GLYDGPVHEV), and SEQ ID NO: 396 (GVFDGLHTV), of about $10^{-6}$M or weaker (e.g., about $10^{-6}$ M, $10^{-5}$M, $10^{-4}$ M, $10^{-3}$ M, $10^{-2}$ M, or $10^{-1}$ M).

In certain embodiments, the antigen binding protein comprises a binding affinity for a MAGE-A4 peptide comprising the amino acid sequence set forth in SEQ ID NO: 394 (GLADGRTHTV), SEQ ID NO: 395 (GLYDGPVHEV), and SEQ ID NO: 396 (GVFDGLHTV), of about $10^{-6}$ M or weaker (e.g., about $10^{-6}$ M, $10^{-5}$ M, $10^{-4}$ M, $10^{-3}$ M, $10^{-2}$ M, or $10^{-1}$ M).

In certain embodiments, the antigen binding protein comprises a single chain variable fragment (scFv), a Fab fragment, a Fab' fragment, a Fv fragment, a diabody, a small antibody mimetic or a single domain antibody, such as a sdAb, a sdFv, a nanobody, a V-Nar or a VHH.

In certain embodiments, the antigen binding protein comprises: (a) an antibody heavy chain variable (VH) domain comprising an HCDR1 amino acid sequence, an HCDR2 amino acid sequence, and an HCDR3 amino acid sequence as set forth in M0848 of Table 6, and an antibody light chain variable (VL) domain comprising an LCDR1 amino acid sequence, an LCDR2 amino acid sequence, and an LCDR3 amino acid sequence as set forth in M0848 of Table 6; (b) an antibody heavy chain variable (VH) domain comprising an HCDR1 amino acid sequence, an HCDR2 amino acid sequence, and an HCDR3 amino acid sequence as set forth in M0849 of Table 6, and an antibody light chain variable (VL) domain comprising an LCDR1 amino acid sequence, an LCDR2 amino acid sequence, and an LCDR3 amino acid sequence as set forth in M0849 of Table 6; (c) an antibody heavy chain variable (VH) domain comprising an HCDR1 amino acid sequence, an HCDR2 amino acid sequence, and an HCDR3 amino acid sequence as set forth in M0850 of Table 6, and an antibody light chain variable (VL) domain comprising an LCDR1 amino acid sequence, an LCDR2 amino acid sequence, and an LCDR3 amino acid sequence as set forth in M0850 of Table 6; (d) an antibody heavy chain variable (VH) domain comprising an HCDR1 amino acid sequence, an HCDR2 amino acid sequence, and an HCDR3 amino acid sequence as set forth in M0851 of Table 6, and an antibody light chain variable (VL) domain comprising an LCDR1 amino acid sequence, an LCDR2 amino acid sequence, and an LCDR3 amino acid sequence as set forth in M0851 of Table 6; (e) an antibody heavy chain variable (VH) domain comprising an HCDR1 amino acid sequence, an HCDR2 amino acid sequence, and an HCDR3 amino acid sequence as set forth in M0852 of Table 6, and an antibody light chain variable (VL) domain comprising an LCDR1 amino acid sequence, an LCDR2 amino acid sequence, and an LCDR3 amino acid sequence as set forth in M0852 of Table 6; (f) an antibody heavy chain variable (VH) domain comprising an HCDR1 amino acid sequence, an HCDR2 amino acid sequence, and an HCDR3 amino acid sequence as set forth in M0853 of Table 6, and an antibody light chain variable (VL) domain comprising an LCDR1 amino acid sequence, an LCDR2 amino acid sequence, and an LCDR3 amino acid sequence as set forth in M0853 of Table 6; (g) an antibody heavy chain variable (VH) domain comprising an HCDR1 amino acid sequence, an HCDR2 amino acid sequence, and an HCDR3 amino acid sequence as set forth in M0854 of Table 6, and an antibody light chain variable (VL) domain comprising an LCDR1 amino acid sequence, an LCDR2 amino acid sequence, and an LCDR3 amino acid sequence as set forth in M0854 of Table 6; (h) an antibody heavy chain variable (VH) domain comprising an HCDR1 amino acid sequence, an HCDR2 amino acid sequence, and an HCDR3 amino acid sequence as set forth in M0855 of Table 6, and an antibody light chain variable (VL) domain comprising an LCDR1 amino acid sequence, an LCDR2 amino acid sequence, and an LCDR3 amino acid sequence as set forth in M0855 of Table 6; (i) an antibody heavy chain variable (VH) domain comprising an HCDR1 amino acid sequence, an HCDR2 amino acid sequence, and an HCDR3 amino acid sequence as set forth in M0856 of Table 6, and an antibody light chain variable (VL) domain comprising an LCDR1 amino acid sequence, an LCDR2 amino acid sequence, and an LCDR3 amino acid sequence as set forth in M0856 of Table 6; (j) an antibody heavy chain variable (VH) domain comprising an HCDR1 amino acid sequence, an HCDR2 amino acid sequence, and an HCDR3 amino acid sequence as set forth in M0857 of Table 6, and an antibody light chain variable (VL) domain comprising an LCDR1 amino acid sequence, an LCDR2 amino acid sequence, and an LCDR3 amino acid sequence as set forth in M0857 of Table 6; (k) an antibody heavy chain variable (VH) domain comprising an HCDR1 amino acid sequence, an HCDR2 amino acid sequence, and an HCDR3 amino acid sequence as set forth in M0858 of Table 6, and an antibody light chain variable (VL) domain comprising an LCDR1 amino acid sequence, an LCDR2 amino acid sequence, and an LCDR3 amino acid sequence as set forth in M0858 of Table 6; (l) an antibody heavy chain variable (VH) domain comprising an HCDR1 amino acid sequence, an HCDR2 amino acid sequence, and an HCDR3 amino acid sequence as set forth in M0859 of Table 6, and an antibody light chain variable (VL) domain comprising an LCDR1 amino acid sequence, an LCDR2 amino acid sequence, and an LCDR3 amino acid sequence as set forth in M0859 of Table 6; (m) an antibody heavy chain variable (VH) domain comprising an HCDR1 amino acid sequence, an HCDR2 amino acid sequence, and an HCDR3 amino acid sequence as set forth in M0860 of Table 6, and an antibody light chain variable (VL) domain comprising an LCDR1 amino acid sequence, an LCDR2 amino acid sequence, and an LCDR3 amino acid sequence as set forth in M0860 of Table 6; (n) an antibody heavy chain variable (VH) domain comprising an HCDR1 amino acid sequence, an HCDR2 amino acid sequence, and an HCDR3 amino acid sequence as set forth in M0861 of Table 6, and an antibody light chain variable (VL) domain comprising an LCDR1 amino acid sequence, an LCDR2 amino acid sequence, and an LCDR3 amino acid sequence as set forth in M0861 of Table 6; (o) an antibody heavy chain variable (VH) domain comprising an HCDR1 amino acid sequence, an HCDR2 amino acid sequence, and an HCDR3 amino acid sequence as set forth in M0862 of Table 6, and an antibody light chain variable (VL) domain comprising an LCDR1 amino acid sequence, an LCDR2 amino acid sequence, and an LCDR3 amino acid sequence as set forth in M0862 of Table 6; (p) an antibody heavy chain variable (VH) domain comprising an HCDR1 amino acid sequence, an HCDR2 amino acid sequence, and an HCDR3 amino acid sequence as set forth in M0863 of Table 6, and an antibody light chain variable (VL) domain comprising an LCDR1 amino acid sequence, an LCDR2 amino acid sequence, and an LCDR3 amino acid sequence as set forth in M0863 of Table 6; (q) an antibody heavy chain variable (VH) domain comprising an HCDR1 amino acid sequence, an HCDR2 amino acid sequence, and an HCDR3 amino acid sequence as set forth in M0864 of Table 6, and an antibody light chain variable (VL) domain comprising an LCDR1 amino acid sequence, an LCDR2 amino acid sequence, and an LCDR3 amino acid sequence as set forth in M0864 of Table 6; (r) an antibody heavy chain variable (VH) domain comprising an HCDR1 amino acid sequence, an HCDR2 amino acid sequence, and an HCDR3 amino acid sequence as set forth in M0865 of Table 6, and an antibody light chain variable (VL) domain comprising an LCDR1 amino acid sequence, an LCDR2 amino acid sequence, and an LCDR3 amino acid sequence as set forth in M0865 of Table 6; or (s) an antibody heavy chain variable (VH) domain comprising an HCDR1 amino acid sequence, an HCDR2 amino acid sequence, and an HCDR3 amino acid sequence as set forth in M0866 of Table 6, and an antibody light chain variable (VL) domain comprising an LCDR1 amino acid sequence, an LCDR2 amino acid sequence, and an LCDR3 amino acid sequence as set forth in M0866 of Table 6.

In certain embodiments, the antigen binding proteins of the disclosure comprise at least about 80%, at least about 85%, at least about 90%, at least about 95%, at least about 96%, at least about 97%, at least about 98%, at least about 99%, or 100% sequence similarity or identity to any of the HCDR1, HCDR2, HCDR3, LCDR1, LCDR2, or LCDR3 amino acid sequences as set forth in any one of M0848 to M0866 of Table 6.

In certain embodiments, the antigen binding protein comprises: (a) an antibody heavy chain variable (VH) domain as set forth in M0848 of Table 6, and an antibody light chain variable (VL) domain as set forth in M0848 of Table 6; (b) an antibody heavy chain variable (VH) domain as set forth in M0849 of Table 6, and an antibody light chain variable (VL) domain as set forth in M0849 of Table 6; (c) an antibody heavy chain variable (VH) domain as set forth in M0850 of Table 6, and an antibody light chain variable (VL) domain as set forth in M0850 of Table 6; (d) an antibody heavy chain variable (VH) domain as set forth in M0851 of Table 6, and an antibody light chain variable (VL) domain as set forth in M0851 of Table 6; (e) an antibody heavy chain variable (VH) domain as set forth in M0852 of Table 6, and an antibody light chain variable (VL) domain as set forth in M0852 of Table 6; (f) an antibody heavy chain variable (VH) domain as set forth in M0853 of Table 6, and an antibody light chain variable (VL) domain as set forth in M0853 of Table 6; (g) an antibody heavy chain variable (VH) domain as set forth in M0854 of Table 6, and an antibody light chain variable (VL) domain as set forth in M0854 of Table 6; (h) an antibody heavy chain variable (VH) domain as set forth in M0855 of Table 6, and an antibody light chain variable (VL) domain as set forth in M0855 of Table 6; (i) an antibody heavy chain variable (VH) domain as set forth in M0856 of Table 6, and an antibody light chain variable (VL) domain as set forth in M0856 of Table 6; (j) an antibody heavy chain variable (VH) domain as set forth in M0857 of Table 6, and an antibody light chain variable (VL) domain as set forth in M0857 of Table 6; (k) an antibody heavy chain variable (VH) domain as set forth in M0858 of Table 6, and an antibody light chain variable (VL) domain as set forth in M0858 of Table 6; (l) an antibody heavy chain variable (VH) domain as set forth in M0859 of Table 6, and an antibody light chain variable (VL) domain as set forth in M0859 of Table 6; (m) an antibody heavy chain variable (VH) domain as set forth in M0860 of Table 6, and an antibody light chain variable (VL) domain as set forth in M0860 of Table 6; (n) an antibody heavy chain variable (VH) domain as set forth in M0861 of Table 6, and an antibody light chain variable (VL) domain as set forth in M0861 of Table 6; (o) an antibody heavy chain variable (VH) domain as set forth in M0862 of Table 6, and an antibody light chain variable (VL) domain as set forth in M0862 of Table 6; (p) an antibody heavy chain variable (VH) domain as set forth in M0863 of Table 6, and an antibody light chain variable (VL) domain as set forth in M0863 of Table 6; (q) an antibody heavy chain variable (VH) domain as set forth in M0864 of Table 6, and an antibody light chain variable (VL) domain as set forth in M0864 of Table 6; (r) an antibody heavy chain variable (VH) domain as set forth in M0865 of Table 6, and an antibody light chain variable (VL) domain as set forth in M0865 of Table 6; or (s) an antibody heavy chain variable (VH) domain as set forth in M0866 of Table 6, and an antibody light chain variable (VL) domain as set forth in M0866 of Table 6.

In certain embodiments, the antigen binding proteins of the disclosure comprise at least about 80%, at least about 85%, at least about 90%, at least about 95%, at least about 96%, at least about 97%, at least about 98%, at least about 99%, or 100% sequence similarity or identity to any of the VH or VL amino acid sequences as set forth in any one of M0848 to M0866 of Table 6.

Select antigen binding proteins of the disclosure possess exceptional binding affinity to MAGE-A4 pMHC of about 5 nM or less (e.g., about 5 nM, about 4.5 nM, about 4 nM, about 3.5 nM, about 3 nM, about 2.5 nM, about 2 nM, about 1.5 nM, about 1 nM, about 0.5 nM, about 0.1 nM, about 0.05 nM, about 0.01 nM, or less). In particular embodiments, the antigen binding proteins comprise a binding affinity of 1 nM or less (e.g., about 1 nM, about 0.5 nM, about 0.1 nM, about 0.05 nM, about 0.01 nM, or less). Said antigen binding proteins comprise a set of six CDR sequences, with a consensus HCDR2, HCDR3, and LCDR3 amino acid sequence and identical HCDR1, LCDR1, and LCDR2 amino acid sequences.

In certain embodiments, the antigen binding protein comprises: (a) an antibody heavy chain variable (VH) domain comprising an HCDR1 amino acid sequence of SNYAMS (SEQ ID NO: 469), an HCDR2 amino acid sequence of IVSSGGTTYYAX$_1$X$_2$X$_3$KG (SEQ ID NO: 881), wherein X$_1$ corresponds to amino acid S or D, X$_2$ corresponds to amino acid W or S, and X$_3$ corresponds to amino acid A or V, and an HCDR3 amino acid sequence of DLYYGPX$_4$TX$_5$YX$_6$X$_7$X$_8$NL (SEQ ID NO: 882), wherein X$_4$ corresponds to amino acid T, N, or S, X$_5$ corresponds to amino acid D or is absent, X$_6$ corresponds to amino acid S or F, X$_7$ corresponds to amino acid A or V, and X$_8$ corresponds to amino acid F or A; and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATX$_9$X$_{10}$X$_{11}$SGSNFQX$_{12}$ (SEQ ID NO: 883), wherein X$_9$ corresponds to amino acid S or R, X$_{10}$ corresponds to amino acid D or P, X$_{11}$ corresponds to amino acid G, S, or F, and X$_{12}$ corresponds to amino acid L or A.

In certain embodiments, the antigen binding protein does not comprise: (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 470), and an HCDR3 amino acid sequence of DLYYGPTTYSAFNL (SEQ ID NO: 471); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATSDGSGSNFQL (SEQ ID NO: 474).

In certain embodiments, the antigen binding protein comprises: (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 657), and an HCDR3 amino acid sequence of DLYYGPSTYFVANL (SEQ ID NO: 731); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQL (SEQ ID NO: 879).

In certain embodiments, the antigen binding protein comprises: (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 653), and an HCDR3 amino acid sequence of DLYYGPTTYSAANL (SEQ ID NO: 727); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRDFSGSNFQL (SEQ ID NO: 875).

In certain embodiments, the antigen binding protein comprises: (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 658), and an HCDR3 amino acid sequence of DLYYGPNTDYSAANL (SEQ ID NO: 732); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQA (SEQ ID NO: 880).

In certain embodiments, the antigen binding protein comprises: (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 624), and an HCDR3 amino acid sequence of DLYYGPTTYSAFNL (SEQ ID NO: 698); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQA (SEQ ID NO: 846).

In certain embodiments, the antigen binding protein comprises: (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 470), and an HCDR3 amino acid sequence of DLYYGPTTYSAFNL (SEQ ID NO: 471); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATSDGSGSNFQL (SEQ ID NO: 474).

In certain embodiments, the antigen binding protein comprises: (a) an antibody heavy chain variable (VH) domain comprising a framework region, an HCDR1 region, an HCDR2 region, and an HCDR3 region, wherein the VH domain comprises an amino acid sequence set forth in SEQ ID NO: 575, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 575 and 100% identity to the HCDR1 region, HCDR2 region, and HCDR3 region set forth in SEQ ID NO: 575; and (b) an antibody light chain variable (VL) domain comprising a framework region, an LCDR1 region, an LCDR2 region, and an LCDR3 region, wherein the VL domain comprises an amino acid sequence set forth in SEQ ID NO: 797, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 797 and 100% identity to the LCDR1 region, LCDR2 region, and LCDR3 region set forth in SEQ ID NO: 797.

In certain embodiments, the antigen binding protein comprises: (a) an antibody heavy chain variable (VH) domain comprising a framework region, an HCDR1 region, an HCDR2 region, and an HCDR3 region, wherein the VH domain comprises an amino acid sequence set forth in SEQ ID NO: 583, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 583 and 100% identity to the HCDR1 region, HCDR2 region, and HCDR3 region set forth in SEQ ID NO: 583; and (b) an antibody light chain variable (VL) domain comprising a framework region, an LCDR1 region, an LCDR2 region, and an LCDR3 region, wherein the VL domain comprises an amino acid sequence set forth in SEQ ID NO: 805, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 805 and 100% identity to the LCDR1 region, LCDR2 region, and LCDR3 region set forth in SEQ ID NO: 805.

In certain embodiments, the antigen binding protein comprises: (a) an antibody heavy chain variable (VH) domain comprising a framework region, an HCDR1 region, an HCDR2 region, and an HCDR3 region, wherein the VH domain comprises an amino acid sequence set forth in SEQ ID NO: 579, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 579 and 100% identity to the HCDR1 region, HCDR2 region, and HCDR3 region set forth in SEQ ID NO: 579; and (b) an antibody light chain variable (VL) domain comprising a framework region, an LCDR1 region, an LCDR2 region, and an LCDR3 region, wherein the VL domain comprises an amino acid sequence set forth in SEQ ID NO: 801 or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 801 and 100% identity to the LCDR1 region, LCDR2 region, and LCDR3 region set forth in SEQ ID NO: 801.

In certain embodiments, the antigen binding protein comprises: (a) an antibody heavy chain variable (VH) domain comprising a framework region, an HCDR1 region, an HCDR2 region, and an HCDR3 region, wherein the VH domain comprises an amino acid sequence set forth in SEQ ID NO: 582, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 582 and 100% identity to the HCDR1 region, HCDR2 region, and HCDR3 region set forth in SEQ ID NO: 582; and (b) an antibody light chain variable (VL) domain comprising a framework region, an LCDR1 region, an LCDR2 region, and an LCDR3 region, wherein the VL domain comprises an amino acid sequence set forth in SEQ ID NO: 804 or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 804 and 100% identity to the LCDR1 region, LCDR2 region, and LCDR3 region set forth in SEQ ID NO: 804.

In certain embodiments, the antigen binding protein comprises: (a) an antibody heavy chain variable (VH) domain comprising a framework region, an HCDR1 region, an HCDR2 region, and an HCDR3 region, wherein the VH domain comprises an amino acid sequence set forth in SEQ ID NO: 584, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 584 and 100% identity to the HCDR1 region, HCDR2 region, and HCDR3 region set forth in SEQ ID NO: 584; and (b) an antibody light chain variable (VL) domain comprising a framework region, an LCDR1 region, an LCDR2 region, and an LCDR3 region, wherein the VL domain comprises an amino acid sequence set forth in SEQ ID NO: 806 or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 806 and 100% identity to the LCDR1 region, LCDR2 region, and LCDR3 region set forth in SEQ ID NO: 806.

In certain embodiments, the antigen binding protein comprises: (a) an antibody heavy chain variable (VH) domain comprising a framework region, an HCDR1 region, an HCDR2 region, and an HCDR3 region, wherein the VH domain comprises an amino acid sequence set forth in SEQ ID NO: 550, or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 550 and 100% identity to the HCDR1 region, HCDR2 region, and HCDR3 region set forth in SEQ ID NO: 550; and (b) an antibody light chain variable (VL) domain comprising a framework region, an LCDR1 region, an LCDR2 region, and an LCDR3 region, wherein the VL domain comprises an amino acid sequence set forth in SEQ ID NO: 772 or an amino acid sequence with at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to the framework region of the amino acid sequence set forth in SEQ ID NO: 772 and 100% identity to the LCDR1 region, LCDR2 region, and LCDR3 region set forth in SEQ ID NO: 772.

In certain embodiments, one or more of the HCDR1 amino acid sequence, the HCDR2 amino acid sequence, the HCDR3 amino acid sequence, the LCDR1 amino acid sequence, the LCDR2 amino acid sequence, and the LCDR3 amino acid sequence comprises one or more amino acid substitutions.

In certain embodiments, the antigen binding protein retains binding specificity to the target MAGE-A4 pMHC after the one or more amino acid substitutions.

In certain embodiments, one or more of the VH domain and the VL domain comprises one or more amino acid substitutions.

In certain embodiments, the antigen binding protein retains binding specificity to the target MAGE-A4 pMHC after the one or more amino acid substitutions.

In another aspect, the disclosure provides an antigen binding protein that specifically recognizes a target Melanoma-Associated Antigen A4 (MAGE-A4) peptide-MHC (pMHC), comprising: (a) an antibody heavy chain variable (VH) domain comprising an HCDR1 amino acid sequence of SNYAMS (SEQ ID NO: 469), an HCDR2 amino acid sequence of IVSSGGTTYYAX$_1$X$_2$X$_3$KG (SEQ ID NO: 881), wherein X$_1$ corresponds to amino acid S or D, X$_2$ corresponds to amino acid W or S, and X$_3$ corresponds to amino acid A or V, and an HCDR3 amino acid sequence of DLYYGPX$_4$TX$_5$YX$_6$X$_7$X$_8$NL (SEQ ID NO: 882), wherein X$_4$ corresponds to amino acid T, N, or S, X$_5$ corresponds to amino acid D or is absent, X$_6$ corresponds to amino acid S or F, X$_7$ corresponds to amino acid A or V, and X$_6$ corresponds to amino acid F or A; and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATX$_9$X$_{10}$X$_{11}$SGSNFQX$_{12}$ (SEQ ID NO: 883), wherein X$_9$ corresponds to amino acid S or R, X$_{10}$ corresponds to amino acid D or P, X$_{11}$ corresponds to amino acid G, S, or F, and X$_{12}$ corresponds to amino acid L or A.

In certain embodiments, the antigen binding protein does not comprise: (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 470), and an HCDR3 amino acid sequence of DLYYGPTYSAFNL (SEQ ID NO: 471); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATSDGSGSNFQL (SEQ ID NO: 474).

In another aspect, the disclosure provides an antigen binding protein that specifically recognizes a target Melanoma-Associated Antigen A4 (MAGE-A4) peptide-MHC (pMHC), comprising: (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 657), and an HCDR3 amino acid sequence of DLYYGPSTYFVANL (SEQ ID NO: 731); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQL (SEQ ID NO: 879).

In certain embodiments, the antigen binding protein comprises an antibody VH domain comprising an amino acid sequence of set forth in SEQ ID NO: 583 and an antibody VL domain comprising an amino acid sequence of set forth in SEQ ID NO: 805, or a VH domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 583 and a VL domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 805.

In another aspect, the disclosure provides an antigen binding protein that specifically recognizes a target Melanoma-Associated Antigen A4 (MAGE-A4) peptide-MHC (pMHC), comprising: (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 653), and an HCDR3 amino acid sequence of DLYYGPTYSAANL (SEQ ID NO: 727); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRDFSGSNFQL (SEQ ID NO: 875).

In certain embodiments, the antigen binding protein comprises an antibody VH domain comprising an amino acid sequence of set forth in SEQ ID NO: 579 and an antibody VL domain comprising an amino acid sequence of set forth in SEQ ID NO: 801, or a VH domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 579 and a VL domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 801.

In another aspect, the disclosure provides an antigen binding protein that specifically recognizes a target Melanoma-Associated Antigen A4 (MAGE-A4) peptide-MHC (pMHC), comprising: (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 658), and an HCDR3 amino acid sequence of DLYYGPNTDYSAANL (SEQ ID NO: 732); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQA (SEQ ID NO: 880).

In certain embodiments, the antigen binding protein comprises an antibody VH domain comprising an amino acid sequence of set forth in SEQ ID NO: 584 and an antibody VL domain comprising an amino acid sequence of set forth in SEQ ID NO: 806, or a VH domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 584 and a VL domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 806

In another aspect, the disclosure provides an antigen binding protein that specifically recognizes a target Melanoma-Associated Antigen A4 (MAGE-A4) peptide-MHC (pMHC), comprising: (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 624), and an HCDR3 amino acid sequence of DLYYGPTYSAFNL (SEQ ID NO: 698); and (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQA (SEQ ID NO: 846).

In certain embodiments, the antigen binding protein comprises an antibody VH domain comprising an amino acid sequence of set forth in SEQ ID NO: 550 and an antibody VL domain comprising an amino acid sequence of set forth in SEQ ID NO: 772, or a VH domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 550 and a VL domain comprising at least 80% identity (e.g., 80%, 81%, 82%, 83%, 84%, 85%, 86%, 87%, 88%, 89%, 90%, 91%, 92%, 93%, 94%, 95%, 96%, 97%, 98%, 99%, or 100% identity) to SEQ ID NO: 772.

In certain embodiments, the antigen binding protein comprises one or more of the following characteristics: (i) the antigen binding protein comprises a binding affinity for the target MAGE-A4 pMHC of about $10^{-9}$ M to about $10^{-14}$ M; (ii) the antigen binding protein comprises a binding affinity for a non-MAGE-A4 pMHC and/or a peptide-free MHC of about $10^{-6}$ M or weaker; (iii) the antigen binding protein comprises a binding affinity for a non-target MAGE-A4 pMHC of about $10^{-6}$ M or weaker; and (iv) the antigen binding protein comprises a binding affinity for the target MAGE-A4 pMHC of about $10^{-9}$ M to about $10^{-14}$ M, and a binding affinity for the MAGE-A4 peptide, an HLA polypeptide, and a beta-2-microglobuin polypeptide alone of about $10^{-6}$ M or weaker.

In certain embodiments, the antigen binding protein comprises specificity for a MAGE-A4 peptide amino acid sequence set forth in SEQ ID NO: 3 (GVYDGREHTV).

In certain embodiments, the VH domain and VL domain are attached with an amino acid linker.

In certain embodiments, the amino acid linker comprises (GGGGS)n, wherein n is an integer between 1 and 5 (SEQ ID NO: 888).

In certain embodiments, the amino acid linker comprises the amino acid sequence GGGGSGGGGSGGGGS (SEQ ID NO: 889), GGGGSGGGGSGGGGSGGGGS (SEQ ID NO: 890), or GGGGSGGGGSGGGGSGGGGAS (SEQ ID NO: 891).

In another aspect, the disclosure provides a human or humanized antigen binding protein comprising the HCDR1, HCDR2, HCDR3, LCDR1, LCDR2, and LCDR3 amino acid sequences as set forth in any one of M0848 to M0866 of Table 6.

In another aspect, the disclosure provides a human or humanized antigen binding protein comprising the HCDR1, HCDR2, HCDR3, LCDR1, LCDR2, and LCDR3 amino acid sequences from M0848 of Table 6. In another aspect, the disclosure provides a human or humanized antigen binding protein comprising the HCDR1, HCDR2, HCDR3, LCDR1, LCDR2, and LCDR3 amino acid sequences from M0849 of Table 6. In another aspect, the disclosure provides a human or humanized antigen binding protein comprising the HCDR1, HCDR2, HCDR3, LCDR1, LCDR2, and LCDR3 amino acid sequences from M0850 of Table 6. In another aspect, the disclosure provides a human or humanized antigen binding protein comprising the HCDR1, HCDR2, HCDR3, LCDR1, LCDR2, and LCDR3 amino acid sequences from M0851 of Table 6. In another aspect, the disclosure provides a human or humanized antigen binding protein comprising the HCDR1, HCDR2, HCDR3, LCDR1, LCDR2, and LCDR3 amino acid sequences from M0852 of Table 6. In another aspect, the disclosure provides a human or humanized antigen binding protein comprising the HCDR1, HCDR2, HCDR3, LCDR1, LCDR2, and LCDR3 amino acid sequences from M0853 of Table 6. In another aspect, the disclosure provides a human or humanized antigen binding protein comprising the HCDR1, HCDR2, HCDR3, LCDR1, LCDR2, and LCDR3 amino acid sequences from M0854 of Table 6. In another aspect, the disclosure provides a human or humanized antigen binding protein comprising the HCDR1, HCDR2, HCDR3, LCDR1, LCDR2, and LCDR3 amino acid sequences from M0855 of Table 6. In another aspect, the disclosure provides a human or humanized antigen binding protein comprising the HCDR1, HCDR2, HCDR3, LCDR1, LCDR2, and LCDR3 amino acid sequences from M0856 of Table 6. In another aspect, the disclosure provides a human or humanized antigen binding protein comprising the HCDR1, HCDR2, HCDR3, LCDR1, LCDR2, and LCDR3 amino acid sequences from M0857 of Table 6. In another aspect, the disclosure provides a human or humanized antigen binding protein comprising the HCDR1, HCDR2, HCDR3, LCDR1, LCDR2, and LCDR3 amino acid sequences from M0858 of Table 6. In another aspect, the disclosure provides a human or humanized antigen binding protein comprising the HCDR1, HCDR2, HCDR3, LCDR1, LCDR2, and LCDR3 amino acid sequences from M0859 of Table 6. In another aspect, the disclosure provides a human or humanized antigen binding protein comprising the HCDR1, HCDR2, HCDR3, LCDR1, LCDR2, and LCDR3 amino acid sequences from M0860 of Table 6. In another aspect, the disclosure provides a human or humanized antigen binding protein comprising the HCDR1, HCDR2, HCDR3, LCDR1, LCDR2, and LCDR3 amino acid sequences from M0861 of Table 6. In another aspect, the disclosure provides a human or humanized antigen binding protein comprising the HCDR1, HCDR2, HCDR3, LCDR1, LCDR2, and LCDR3 amino acid sequences from M0862 of Table 6. In another aspect, the disclosure provides a human or humanized antigen binding protein comprising the HCDR1, HCDR2, HCDR3, LCDR1, LCDR2, and LCDR3 amino acid sequences from M0863 of Table 6. In another aspect, the disclosure provides a human or humanized antigen binding protein comprising the HCDR1, HCDR2, HCDR3, LCDR1, LCDR2, and LCDR3 amino acid sequences from M0864 of Table 6. In another aspect, the disclosure provides a human or humanized antigen binding protein comprising the HCDR1, HCDR2, HCDR3, LCDR1, LCDR2, and LCDR3 amino acid sequences from M0865 of Table 6. In another aspect, the disclosure provides a human or humanized antigen binding protein comprising the HCDR1, HCDR2, HCDR3, LCDR1, LCDR2, and LCDR3 amino acid sequences from M0866 of Table 6.

In certain embodiments, the human or humanized antigen binding protein comprises substitutions in the LCDR2 sequence of any of M0700-M0866 disclosed in Table 6, in particular of M0709, M0739, M0742, M0743, M0747 or M0763. In some embodiments thereof, the antigen binding protein additionally comprises substitutions in the corresponding HCDR1, HCDR2 and/or HCDR3 sequences.

In certain embodiments, the human or humanized antigen binding protein comprises substitutions in the LCDR3 sequence of any of M0700-M0866 disclosed in Table 6, in particular of M0709, M0739, M0742, M0743, M0747 or M0763. In some embodiments thereof, the antigen binding protein additionally comprises substitutions in the corresponding HCDR1, HCDR2 and/or HCDR3 sequences.

In certain embodiments, the human or humanized antigen binding protein comprises substitutions in the HCDR1 sequence of any of M0700-M0866 disclosed in Table 6, in particular of M0709, M0739, M0742, M0743, M0747 or M0763. In some embodiments thereof, the antigen binding protein additionally comprises substitutions in the corresponding LCDR1, LCDR2 and/or LCDR3 sequences.

In certain embodiments, the human or humanized antigen binding protein comprises substitutions in the HCDR2 sequence of any of M0700-M0866 disclosed in Table 6, in particular of M0709, M0739, M0742, M0743, M0747 or M0763. In some embodiments thereof, the antigen binding protein additionally comprises substitutions in the corresponding LCDR1, LCDR2 and/or LCDR3 sequences.

In certain embodiments, the human or humanized antigen binding protein comprises substitutions in the HCDR3 sequence of any of M0700-M0866 disclosed in Table 6, in particular of M0709, M0739, M0742, M0743, M0747 or M0763. In some embodiments thereof, the antigen binding protein additionally comprises substitutions in the corresponding LCDR1, LCDR2 and/or LCDR3 sequences.

In certain embodiments, the human or humanized antigen binding protein is a variant of the sequences disclosed herein and comprises substitutions in LCDR3 and/or HCDR3 of any of M0700-M0866 disclosed in Table 6, in particular of M0709, M0739, M0742, M0743, M0747 or M0763.

In certain embodiments, the human or humanized antigen binding protein comprises substitutions in the LCDR1 and LCDR3 sequences of any of M0700-M0866 disclosed in Table 6, in particular of M0709, M0739, M0742, M0743, M0747 or M0763. In some embodiments thereof, the antigen binding protein additionally comprises substitutions in the corresponding HCDR1, HCDR2 and/or HCDR3 sequences.

In certain embodiments, the human or humanized antigen binding protein comprises substitutions in the LCDR2 and LCDR3 sequences of any of M0700-M0866 disclosed in Table 6, in particular of M0709, M0739, M0742, M0743, M0747 or M0763. In some embodiments, the antigen binding protein additionally comprises substitutions in the corresponding HCDR1, HCDR2 and/or HCDR3 sequences.

In certain embodiments, the human or humanized antigen binding protein comprises substitutions in the LCDR2 and LCDR3 sequences of any of M0700-M0866 disclosed in Table 6, in particular of M0709, M0739, M0742, M0743, M0747 or M0763. In some embodiments, the antigen binding protein additionally comprises substitutions in the corresponding HCDR1, HCDR2 and/or HCDR3 sequences.

In certain embodiments, the human or humanized antigen binding protein comprises substitutions in the LCDR1, LCDR2 and LCDR3 sequences of any of M0700-M0866 disclosed in Table 6, in particular of M0709, M0739, M0742, M0743, M0747 or M0763. In some embodiments, the antigen binding protein additionally comprises substitutions in the corresponding HCDR1, HCDR2 and/or HCDR3 sequences.

In certain embodiments, the human or humanized antigen binding protein comprises substitutions in the HCDR1 and HCDR3 sequences of any of M0700-M0866 disclosed in Table 6, in particular of M0709, M0739, M0742, M0743, M0747 or M0763. In some embodiments, the antigen binding protein additionally comprises substitutions in the corresponding LCDR1, LCDR2 and/or LCDR3 sequences.

In certain embodiments, the human or humanized antigen binding protein comprises substitutions in the HCDR1 and HCDR2 sequences of any of M0700-M0866 disclosed in Table 6, in particular of M0709, M0739, M0742, M0743, M0747 or M0763. In some embodiments, the antigen binding protein additionally comprises substitutions in the corresponding LCDR1, LCDR2 and/or LCDR3 sequences.

In certain embodiments, the human or humanized antigen binding protein comprises substitutions in the HCDR2 and HCDR3 sequences of any of M0700-M0866 disclosed in Table 6, in particular of M0709, M0739, M0742, M0743, M0747 or M0763. In some embodiments, the antigen binding protein additionally comprises substitutions in the corresponding LCDR1, LCDR2 and/or LCDR3 sequences.

In certain embodiments, the human or humanized antigen binding protein comprises substitutions in the HCDR1, HCDR2 and HCDR3 sequences of any of M0700-M0866 disclosed in Table 6, in particular of M0709, M0739, M0742, M0743, M0747 or M0763. In some embodiments, the antigen binding protein additionally comprises substitutions in the corresponding LCDR1, LCDR2 and/or LCDR3 sequences.

For the avoidance of doubt, the combinations set forth above refer to the CDRs of matching VL-VH pairs of the antigen binding proteins depicted in Table 6.

In certain embodiments, such variant antigen binding protein retains specific binding to its target (e.g., GVYDGREHTV (SEQ ID NO: 3)) and/or competes with the antigen binding protein disclosed herein for binding to its target. The variants, i.e., mutated sequences, can be tested by routine methods for their chemical, biological, biophysical and/or biochemical properties. In certain embodiments, the amino acid substitution does not substantially change the functional and/or structural characteristics of the parental sequence. Accordingly, the binding characteristics of an antigen binding protein including such conservative substitution(s) are at least essentially unaltered. In certain embodiments, the amino acid substitution(s) do(es) not substantially modify or disrupt the secondary structure of the parental sequence.

In certain embodiments, the variant antigen binding protein retains a binding affinity for the target MAGE-A4 pMHC of about 10-9 M to about 10-14 M and/or comprises a binding affinity for a non-MAGE-A4 pMHC and/or a peptide-free MHC of about 10-6 M or weaker and/or comprises a binding affinity for a non-target MAGE-A4 pMHC of about 10-6 M or weaker; and/or comprises a binding affinity for the target MAGE-A4 pMHC of about 10-9 M to about 10-14 M, and a binding affinity for the MAGE-A4 peptide, an HLA polypeptide, and a beta-2-microglobuin polypeptide alone of about 10-6 M or weaker.

In another aspect, the disclosure provides a single domain antibody (e.g., a sdAb, a sdFv, a nanobody, a V-Nar or a VHH) that specifically recognizes a target Melanoma-Associated Antigen A4 (MAGE-A4) peptide-MHC (pMHC). Single domain antibodies, such as a VHH, are smaller than traditional antibodies, which may permit them to penetrate the tumor microenvironment better. Moreover, the smaller binding area of the single domain antibody may confer superior binding affinity and specificity for a peptide-bound MHC.

In certain embodiments, the single domain antibody comprises a binding affinity for the target MAGE-A4 pMHC of about $10^{-9}$ M to about $10^{-14}$ M.

In certain embodiments, the single domain antibody comprises a binding affinity for a non-MAGE-A4 peptide-MHC and/or a peptide-free MHC of about $10^{-6}$ M or weaker.

In certain embodiments, the single domain antibody comprises a binding affinity for a non-target MAGE-A4 pMHC of about $10^{-6}$ M or weaker.

In certain embodiments, the antigen binding protein (e.g., the single domain antibody) comprises: (a) an antibody VHH domain comprising an HCDR1 amino acid sequence, an HCDR2 amino acid sequence, and an HCDR3 amino acid sequence as set forth in M0734 of Table 8; (b) an antibody VHH domain comprising an HCDR1 amino acid sequence, an HCDR2 amino acid sequence, and an HCDR3 amino acid sequence as set forth in M0735 of Table 8; (c) an antibody VHH domain comprising an HCDR1 amino acid sequence, an HCDR2 amino acid sequence, and an HCDR3 amino acid sequence as set forth in M0736 of Table 8; (d) an antibody VHH domain comprising an HCDR1 amino acid sequence, an HCDR2 amino acid sequence, and an HCDR3 amino acid sequence as set forth in M0737 of Table 8; (e) an antibody VHH domain comprising an HCDR1 amino acid sequence, an HCDR2 amino acid sequence, and an HCDR3 amino acid sequence as set forth in M0738 of Table 8; (f) an antibody VHH domain comprising an HCDR1 amino acid sequence, an HCDR2 amino acid sequence, and an HCDR3 amino acid sequence as set forth in M0739 of Table 8; (g) an antibody VHH domain comprising an HCDR1 amino acid sequence, an HCDR2 amino acid sequence, and an HCDR3 amino acid sequence as set forth in M0740 of Table 8; (h) an antibody VHH domain comprising an HCDR1 amino acid sequence, an HCDR2 amino acid sequence, and an HCDR3 amino acid sequence as set forth in M0741 of Table 8; (i) an antibody VHH domain comprising an HCDR1 amino acid sequence, an HCDR2 amino acid sequence, and an HCDR3 amino acid sequence as set forth in M0742 of Table 8; (j) an antibody VHH domain comprising an HCDR1 amino acid sequence, an HCDR2 amino acid sequence, and an HCDR3 amino acid sequence as set forth in M0743 of Table 8; (k) an antibody VHH domain comprising an HCDR1 amino acid sequence, an HCDR2 amino acid sequence, and an HCDR3 amino acid sequence as set forth in M0744 of Table 8; (l) an antibody VHH domain comprising an HCDR1 amino acid sequence, an HCDR2 amino acid sequence, and an HCDR3 amino acid sequence as set forth in M0745 of Table 8; (m) an antibody VHH domain comprising an HCDR1 amino acid sequence, an HCDR2 amino acid sequence, and an HCDR3 amino acid sequence as set forth in M0746 of Table 8; (n) an antibody VHH domain comprising an HCDR1 amino acid sequence, an HCDR2 amino acid sequence, and an HCDR3 amino acid sequence as set forth in M0747 of Table 8; (o) an antibody VHH domain comprising an HCDR1 amino acid sequence, an HCDR2 amino acid sequence, and an HCDR3 amino acid sequence as set forth in M0748 of Table 8; (p) an antibody VHH domain comprising an HCDR1 amino acid sequence, an HCDR2 amino acid sequence, and an HCDR3 amino acid sequence as set forth in M0749 of Table 8; (q) an antibody VHH domain comprising an HCDR1 amino acid sequence, an HCDR2 amino acid sequence, and an HCDR3 amino acid sequence as set forth in M0750 of Table 8; (r) an antibody VHH domain comprising an HCDR1 amino acid sequence, an HCDR2 amino acid sequence, and an HCDR3 amino acid sequence as set forth in M0751 of Table 8; or (s) an antibody VHH domain comprising an HCDR1 amino acid sequence, an HCDR2 amino acid sequence, and an HCDR3 amino acid sequence as set forth in M0752 of Table 8.

In certain embodiments, the antigen binding proteins of the disclosure comprise at least about 80%, at least about 85%, at least about 90%, at least about 95%, at least about 96%, at least about 97%, at least about 98%, at least about 99%, or 100% sequence similarity or identity to any of the HCDR1, HCDR2, or HCDR3 amino acid sequences as set forth in any one of M0734 to M0752 of Table 8.

In certain embodiments, the antigen binding protein comprises: (a) an antibody VHH domain as set forth in M0734 of Table 8; (b) an antibody VHH domain as set forth in M0735 of Table 8; (c) an antibody VHH domain as set forth in M0736 of Table 8; (d) an antibody VHH domain as set forth in M0737 of Table 8; (e) an antibody VHH domain as set forth in M0738 of Table 8; (f) an antibody VHH domain as set forth in M0739 of Table 8; (g) an antibody VHH domain as set forth in M0740 of Table 8; (h) an antibody VHH domain as set forth in M0741 of Table 8; (i) an antibody VHH domain as set forth in M0742 of Table 8; (j) an antibody VHH domain as set forth in M0743 of Table 8; (k) an antibody VHH domain as set forth in M0744 of Table 8; (l) an antibody VHH domain as set forth in M0745 of Table 8; (m) an antibody VHH domain as set forth in M0746 of Table 8; (n) an antibody VHH domain as set forth in M0747 of Table 8; (o) an antibody VHH domain as set forth in M0748 of Table 8; (p) an antibody VHH domain as set forth in M0749 of Table 8; (q) an antibody VHH domain as set forth in M0750 of Table 8; (r) an antibody VHH domain as set forth in M0751 of Table 8; or (s) an antibody VHH domain as set forth in M0752 of Table 8.

In certain embodiments, the antigen binding proteins of the disclosure comprise at least about 80%, at least about 85%, at least about 90%, at least about 95%, at least about 96%, at least about 97%, at least about 98%, at least about 99%, or 100% sequence similarity or identity to any of the VHH amino acid sequences as set forth in any one of M0734 to M0752 of Table 8.

In certain embodiments, the antigen binding protein comprises a binding affinity for the MAGE-A4 pMHC of at least about $10^{-9}$ M (e.g., about $10^{-9}$ M, about $10^{-10}$ M, about $10^{-11}$ M, about $10^{-12}$ M, about $10^{-13}$ M, about $10^{-14}$ M).

In certain embodiments, the antigen binding protein comprises a binding affinity for the MAGE-A4 pMHC of about $10^{-9}$ M to about $10^{-14}$ M.

In certain embodiments, the antigen binding protein comprises a binding affinity for the MAGE-A4 pMHC of about $10^{-10}$ M to about $10^{-12}$ M.

In certain embodiments, the antigen binding protein lacks detectable binding affinity for a non-MAGE-A4 pMHC (e.g., a MHC in complex with a peptide that is not derived from the MAGE-A4 protein). An antigen binding protein that lacks detectable binding affinity is a binding affinity that is about the same as a negative control. A negative control can be a binding affinity measurement with the antigen binding protein and no additional antigen.

In certain embodiments, the antigen binding protein lacks detectable binding affinity for a peptide-free MHC (e.g., a MHC that is not in complex with a peptide of any origin).

In certain embodiments, the antigen binding protein lacks detectable binding affinity for a non-target MAGE-A4 pMHC (e.g., a MHC in complex with a MAGE-A4 peptide that differs from the target MAGE-A4 peptide, such as the target MAGE-A4 peptide amino acid sequence set forth in SEQ ID NO: 3 (GVYDGREHTV)).

In certain embodiments, the antigen binding protein lacks detectable binding affinity for MAGE-A4 peptide alone (e.g., a MAGE-A4 peptide that is not in complex with an MHC).

In certain embodiments, the antigen binding protein lacks detectable binding affinity for an HLA polypeptide alone.

In certain embodiments, the antigen binding protein lacks detectable binding affinity for a beta-2-microglobuin polypeptide alone.

In certain embodiments, the antigen binding protein specifically binds the MAGE-A4 pMHC on the surface of a cell. In certain embodiments, the cell is a T2 cell that has been pulsed with the target MAGE-A4 peptide.

In certain embodiments, the antigen binding protein lacks detectable binding affinity for a non-MAGE-A4 pMHC on the surface of a cell. In certain embodiments, the cell is a T2 cell that has been pulsed with the target MAGE-A4 peptide.

In certain embodiments, the antigen binding protein comprises cytotoxic activity against a MAGE-A4 pMHC-expressing cell.

In certain embodiments, the antigen binding protein lacks detectable cytotoxic activity against a non-MAGE-A4 pMHC-expressing cell.

In another aspect, the disclosure provides a bispecific antigen binding protein, comprising a first antigen binding domain comprising the antigen binding protein recited above, and a second antigen binding domain with specificity for a cell surface protein of an immune cell.

In certain embodiments, the immune cell is selected from the group consisting of a T cell, a B cell, a natural killer (NK) cell, a natural killer T (NKT) cell, a neutrophil cell, a monocyte, and a macrophage.

In certain embodiments, the immune cell is a T cell.

In certain embodiments, the cell surface protein of an immune cell is selected from the group consisting of CD3, TCRα, TCRβ, CD16, NKG2D, CD89, CD64, and CD32.

In certain embodiments, the cell surface protein of an immune cell is CD3.

In certain embodiments, the first antigen binding domain comprises an scFv or VHH, and the second antigen binding domain comprises a Fab.

In certain embodiments, the bispecific antigen binding protein further comprises an immune checkpoint inhibitor.

In certain embodiments, the immune checkpoint inhibitor is selected from the group consisting of an anti-CTLA-4 antibody, an anti-PD-L1 antibody, an anti-PD-1 antibody, an anti-TIM-3 antibody, an anti-LAG-3 antibody, an anti-BTLA antibody, an anti-VISTA antibody, and combinations thereof.

In another aspect, the disclosure provides for the use of the antigen binding protein recited above, or the bispecific antigen binding protein recited above, for preparing a pharmaceutical composition for treating a MAGE-A4 associated cancer in a subject.

In another aspect, the disclosure provides a pharmaceutical composition comprising the antigen binding protein recited above, or the bispecific antigen binding protein recited above, and a pharmaceutically acceptable carrier.

In another aspect, the disclosure provides a nucleic acid encoding the antigen binding protein recited above, or the bispecific antigen binding protein recited above.

In another aspect, the disclosure provides an expression vector comprising the nucleic acid recited above.

In another aspect, the disclosure provides a host cell comprising the expression vector recited above.

In another aspect, the disclosure provides a method of manufacturing the antigen binding protein recited above, or the bispecific antigen binding protein recited above, comprising the steps of:
(i) cultivating the host cell recited above under conditions allowing expression of the antigen binding protein or the bispecific antigen binding protein;
(ii) recovering the antigen binding protein or bispecific antigen binding protein; and optionally
(iii) further purifying and/or modifying and/or formulating the antigen binding protein or bispecific antigen binding protein.

MAGE-A4 Peptide-MHC

The antigen binding proteins described herein possess binding specificity to a MAGE-A4 peptide-MHC.

The target peptide may be presented on a MHC class I complex (such as of serotype HLA-A, HLA-B, HLA-C, HLA-E, HLA-F, HLA-G, HLA-K or HLA-L, or their respective subtypes) or an MHC class II complex (such as the serotypes HLA-DP, HLA-DQ, HLA-DR, DM or DO, or their respective subtypes). Each of the serotypes comprise different subtypes. In one embodiment, the antigen binding protein targets a peptide bound to an HLA-A2-MHC complex, also termed HLA-A*02, in particular HLA-A*02:01 comprising the extracellular domain of SEQ ID NO: 1.

Expression of Antigen Binding Proteins

In one aspect, polynucleotides or nucleic acids encoding the antigen binding proteins disclosed herein are provided. Methods of making a antigen binding protein comprising expressing these polynucleotides are also provided.

Polynucleotides encoding the antigen binding proteins disclosed herein are typically inserted in an expression vector for introduction into host cells that may be used to produce the desired quantity of the antigen binding proteins. Accordingly, in certain aspects, the invention provides expression vectors comprising polynucleotides disclosed herein and host cells comprising these vectors and polynucleotides.

The term "vector" or "expression vector" is used herein to mean vectors used in accordance with the present invention as a vehicle for introducing into and expressing a desired gene in a cell. As known to those skilled in the art, such vectors may readily be selected from the group consisting of plasmids, phages, viruses and retroviruses. In general, vectors compatible with the instant invention will comprise a selection marker, appropriate restriction sites to facilitate cloning of the desired gene and the ability to enter and/or replicate in eukaryotic or prokaryotic cells.

Numerous expression vector systems may be employed for the purposes of this invention. For example, one class of vector utilizes DNA elements which are derived from animal viruses such as bovine papilloma virus, polyoma virus, adenovirus, vaccinia virus, baculovirus, retroviruses (e.g., RSV, MMTV, MOMLV or the like), or SV40 virus. Others involve the use of polycistronic systems with internal ribosome binding sites. Additionally, cells which have integrated the DNA into their chromosomes may be selected by introducing one or more markers which allow selection of transfected host cells. The marker may provide for prototrophy to an auxotrophic host, biocide resistance (e.g., antibiotics) or resistance to heavy metals such as copper. The selectable marker gene can either be directly linked to the DNA sequences to be expressed, or introduced into the same cell by co-transformation. Additional elements may also be needed for optimal synthesis of mRNA. These elements may include signal sequences, splice signals, as well as transcriptional promoters, enhancers, and termination signals. In some embodiments, the cloned variable region genes are inserted into an expression vector along with the heavy and light chain constant region genes (e.g., human constant region genes) synthesized as discussed above.

In other embodiments, the antigen binding proteins may be expressed using polycistronic constructs. In such expression systems, multiple gene products of interest such as heavy and light chains of antibodies may be produced from a single polycistronic construct. These systems advantageously use an internal ribosome entry site (IRES) to provide relatively high levels of polypeptides in eukaryotic host cells. Compatible IRES sequences are disclosed in U.S. Pat. No. 6,193,980, which is incorporated by reference herein in its entirety for all purposes. Those skilled in the art will appreciate that such expression systems may be used to effectively produce the full range of polypeptides disclosed in the instant application.

More generally, once a vector or DNA sequence encoding an antibody, or fragment thereof, has been prepared, the expression vector may be introduced into an appropriate host cell. That is, the host cells may be transformed. Introduction of the plasmid into the host cell can be accomplished by various techniques well known to those of skill in the art. These include, but are not limited to, transfection (including electrophoresis and electroporation), protoplast fusion, calcium phosphate precipitation, cell fusion with enveloped DNA, microinjection, and infection with intact virus. See, Ridgway, A. A. G. "Mammalian Expression Vectors" Chapter 24.2, pp. 470-472 Vectors, Rodriguez and Denhardt, Eds. (Butterworths, Boston, Mass. 1988). Plasmid introduction into the host can be by electroporation. The transformed cells are grown under conditions appropriate to the production of the light chains and heavy chains, and assayed for heavy and/or light chain protein synthesis. Exemplary assay techniques include enzyme-linked immunosorbent assay (ELISA), radioimmunoassay (RIA), fluorescence-activated cell sorter analysis (FACS), immunohistochemistry and the like.

As used herein, the term "transformation" shall be used in a broad sense to refer to the introduction of DNA into a recipient host cell that changes the genotype and consequently results in a change in the recipient cell.

Along those same lines, "host cells" refers to cells that have been transformed with vectors constructed using recombinant DNA techniques and encoding at least one heterologous gene. In descriptions of processes for isolation of polypeptides from recombinant hosts, the terms "cell" and "cell culture" are used interchangeably to denote the source of antibody unless it is clearly specified otherwise. In other words, recovery of polypeptide from the "cells" may mean either from spun down whole cells, or from the cell culture containing both the medium and the suspended cells.

In one embodiment, a host cell line used for antibody expression is of mammalian origin. Those skilled in the art can determine particular host cell lines which are best suited for the desired gene product to be expressed therein. Exemplary host cell lines include, but are not limited to, DG44 and DUXB11 (Chinese hamster ovary lines, DHFR minus), HELA (human cervical carcinoma), CV-1 (monkey kidney line), COS (a derivative of CV-1 with SV40 T antigen), R1610 (Chinese hamster fibroblast) BALBC/3T3 (mouse fibroblast), HAK (hamster kidney line), SP2/O (mouse myeloma), BFA-1c1BPT (bovine endothelial cells), RAJI (human lymphocyte), 293 (human kidney) and the like. In one embodiment, the cell line provides for altered glycosylation, e.g., afucosylation, of the antibody expressed therefrom (e.g., PER.C6® (Crucell) or FUT8-knock-out CHO cell lines (Potelligent® cells) (Biowa, Princeton, N.J.)). Host cell lines are typically available from commercial services, e.g., the American Tissue Culture Collection, or from published literature.

In vitro production allows scale-up to give large amounts of the desired polypeptides. Techniques for mammalian cell cultivation under tissue culture conditions are known in the art and include homogeneous suspension culture, e.g., in an airlift reactor or in a continuous stirrer reactor, or immobilized or entrapped cell culture, e.g., in hollow fibers, microcapsules, on agarose microbeads or ceramic cartridges. If necessary and/or desired, the solutions of polypeptides can be purified by the customary chromatography methods, for example gel filtration, ion-exchange chromatography, chromatography over DEAE-cellulose and/or (immuno-) affinity chromatography.

Genes encoding the antigen binding proteins featured in the invention can also be expressed non-mammalian cells such as bacteria or yeast or plant cells. In this regard it will be appreciated that various unicellular non-mammalian microorganisms such as bacteria can also be transformed, i.e., those capable of being grown in cultures or fermentation. Bacteria, which are susceptible to transformation, include members of the enterobacteriaceae, such as strains of *Escherichia coli* or *Salmonella*; Bacillaceae, such as *Bacillus subtilis*; Pneumococcus; *Streptococcus*, and *Haemophilus influenzae*. It will further be appreciated that, when expressed in bacteria, the proteins can become part of inclusion bodies. The proteins must be isolated, purified and then assembled into functional molecules.

In addition to prokaryotes, eukaryotic microbes may also be used. *Saccharomyces cerevisiae*, or common baker's yeast, is the most commonly used among eukaryotic microorganisms, although a number of other strains are commonly available. For expression in *Saccharomyces*, the plasmid YRp7, for example (Stinchcomb et al., Nature, 282:39 (1979); Kingsman et al., Gene, 7:141 (1979); Tschemper et al., Gene, 10:157 (1980)), is commonly used. This plasmid already contains the TRP1 gene which provides a selection marker for a mutant strain of yeast lacking the ability to grow in tryptophan, for example ATCC No. 44076 or PEP4-1 (Jones, Genetics, 85:12 (1977)). The presence of the trp1 lesion as a characteristic of the yeast host cell genome then provides an effective environment for detecting transformation by growth in the absence of tryptophan.

Engineering and Optimization of Antigen Binding Proteins

The antigen binding proteins of the disclosure may be engineered or optimized. As used herein, "optimized" or "optimization" refers to the alteration of a antigen binding protein to improve one or more functional properties. Alteration includes, but is not limited to, deletions, substitutions, additions, and/or modifications of one or more amino acids within an antigen binding protein.

As used herein, the term "functional property" is a property of a antigen binding protein for which an improvement (e.g., relative to a conventional antigen binding protein, such as an antibody) is desirable and/or advantageous to one of skill in the art, e.g., in order to improve the manufacturing properties or therapeutic efficacy of a antigen binding protein. In one embodiment, the functional property is stability (e.g., thermal stability). In another embodiment, the functional property is solubility (e.g., under cellular conditions). In yet another embodiment, the functional property is aggregation behavior. In still another embodiment, the functional property is protein expression (e.g., in a prokaryotic cell). In yet another embodiment the functional property is refolding behavior following inclusion body solubilization in a manufacturing process. In certain embodiments, the functional property is not an improvement in antigen binding affinity. In another embodiment, the improvement of one or more functional properties has no substantial effect on the binding affinity of the antigen binding protein.

In certain embodiments, the antigen binding protein of the disclosure is an scFv and is optimized by identifying preferred amino acid residues to be substituted, deleted, and/or added at amino acid positions of interest (e.g., amino acid positions identified by comparing a database of scFv sequences having at least one desirable property, e.g., as selected with Quality Control (QC) assay, versus a database of mature antibody sequences, e.g., the Kabat database) in an antigen binding protein. Thus, the disclosure further provides "enrichment/exclusion" methods for selecting a particular amino acid residue. Still further, the disclosure provides methods of engineering antigen binding proteins (e.g., scFvs) by mutating particular framework amino acid positions identified using the "functional consensus" approach described herein. In certain embodiments, the framework amino acid positions are mutated by substituting the existing amino acid residue by a residue which is found to be an "enriched" residue using the "enrichment/exclusion" analysis methods described herein. In one aspect, the disclosure provides a method of identifying an amino acid position for mutation in a single chain antibody (scFv), the scFv having VH and VL amino acid sequences, the method comprising: a) entering the scFv VH, VL or VH and VL amino acid sequences into a database that comprises a multiplicity of antibody VH, VL or VH and VL amino acid sequences such that the scFv VH, VL or VH and VL amino acid sequences are aligned with the antibody VH, VL or VH and VL amino acid sequences of the database; b) comparing an amino acid position within the scFv VH or VL amino acid sequence with a corresponding position within the antibody VH or VL amino acid sequences of the database; c) determining whether the amino acid position within the scFv VH or VL amino acid sequence is occupied by an amino acid residue that is conserved at the corresponding position within the antibody VH or VL amino acid sequences of the database; and d) identifying the amino acid position within the scFv VH or VL amino acid sequence as an amino acid position for mutation when the amino acid position is occupied by an amino acid residue that is not conserved at the corresponding position within the antibody VH or VL amino acid sequences of the database. ScFV optimization is described in further detail in WO2008110348, WO2009000099, WO2009000098, and WO2009155725, all of which are incorporated herein by reference.

In certain embodiments, the antigen binding protein comprises an Fc domain which is modified such that it does not induce cytotoxic immune responses and/or does not activate complement. For example, one or more substitutions may be introduced into the Fc domain so that its ADCC/ADCP or CDC effector function is inactivated. Such antigen binding protein has the advantage of increased half-life when compared to antibody fragments with a molecular weight below 60 kDa, without mediating mediate cytotoxic immune responses.

Chemical and/or Biological Modifications

In one aspect, the antigen binding protein is chemically and/or biologically modified. For example, the antigen binding protein may be glycosylated, phosphorylated, hydroxylated, PEGylated, HESylated, PASylated, sulfated, labeled with dyes and/or radioisotopes, conjugated with enzymes and/or toxins, and/or Albumin fusion technology. Likewise, any nucleic acid sequence, plasmid or vector and/or host cell described herein may be modified accordingly.

Such modification may for example be done to optimize pharmacodynamics, its water solubility or to lower its side effects. For example, PEGylation, PASylation, HESylation and/or the fusion to serum albumin may be applied to slow down renal clearance, thereby increasing plasma half-life time of the antigen binding protein. In one embodiment, a modification adds a different functionality to the antigen binding protein, for example, a detection label for diagnostics or a toxin to combat cancer cells even more efficiently.

In one embodiment, the antigen binding protein is glycosylated. Glycosylation refers to a process that attaches carbohydrates to proteins. In biological systems, this process is performed enzymatically within the cell as a form of co-translational and/or post-translational modification. A protein can also be chemically glycosylated. The carbohydrates may be N-linked to a nitrogen of asparagine or arginine side-chains; O-linked to the hydroxy oxygen of serine, threonine, tyrosine, hydroxylysine, or hydroxyproline side-chains; employ xylose, fucose, mannose, and N-acetylglucosamine attached to a phospho-serine; and/or adding mannose sugar to a tryptophan residue found in a specific recognition sequence. Glycosylation patterns may, e.g., be controlled by choosing appropriate cell lines, culturing media, protein engineering manufacturing modes and process strategies (see, HOSSLER, P. Optimal and consistent protein glycosylation in mammalian cell culture. Glycobiology 2009, vol. 19, no. 9, p. 936-949.). In some embodiments, the glycosylation patterns of the antigen binding proteins described herein are modified to enhance ADCC and CDC effector function.

The antigen binding protein may be engineered to control or alter the glycosylation pattern, e.g., by deleting and/or adding of one or more glycosylation sites. The creation of glycosylation sites can e.g., be accomplished by introducing the corresponding enzymatic recognition sequence into the amino acid sequence of the antigen binding protein.

In some embodiments, the antigen binding protein is PEGylated. PEGylation may alter the pharmacodynamic and pharmacokinetic properties of a protein. Additionally, PEGylation may reduce the immunogenicity by shielding the PEGylated antigen binding protein from the immune system and/or alter its pharmacokinetics by, e.g., increasing the in vivo stability of the antigen binding protein, protecting it from proteolytic degradation, extending its half-life time and by altering its biodistribution. Typically, polyethyleneglycol (PEG) of an appropriate molecular weight is covalently attached to the protein. Similar effects may be achieved using PEG mimetics, e.g., HESylating or PASylating the antigen binding protein. HESylation utilizes hydroxyethyl starch ("HES") derivatives. During PASylation, the antigen binding protein is linked to conformationally disordered polypeptide sequences composed of the amino acids proline (P), alanine (A) and serine (S).

In certain embodiments, the antigen binding protein is labelled with or conjugated to a second moiety which attributes one or more ancillary functions to the antigen binding protein. For example, the second moiety may have an additional immunological effector function, be effective in drug targeting or useful for detection. The second moiety can, e.g., be chemically linked or fused genetically to the antigen binding protein using known methods in the art. As used herein, the term "label" refers to any substance or ion which is indicative of the presence of the antigen binding protein when detected or measured by physical or chemical means, either directly or indirectly. For example, the label may be directly detectable by, without being limited to, light absorbance, fluorescence, reflectivity, light scatter, phosphorescence, or luminescence properties, molecules or ions detectable by their radioactive properties or molecules or ions detectable by their nuclear magnetic resonance or paramagnetic properties. Examples of indirect detection include light absorbance or fluorescence; for example, various enzymes which cause appropriate substrates to convert, e.g., from non-light absorbing to light absorbing molecules, or from non-fluorescent to fluorescent molecules. A labelled antigen binding protein is particularly useful for in vitro and in vivo detection or diagnostic purposes. For example, an antigen binding protein labelled with a suitable radioisotope, enzyme, fluorophore or chromophore can be detected by radioimmunoassay (RIA), enzyme-linked immunosorbent assay (ELISA), or flow cytometry-based single cell analysis (e.g., FACS analysis), respectively. Similarly, the nucleic acids and/or vectors disclosed herein can be labeled for detection or diagnostic purposes, e.g., using labelled fragments thereof as probes in hybridization assays.

Non-limiting examples of second moieties include radioisotopes (35S, 32P, 14C, 18F, and/or 125I), apoenzymes, enzymes (e.g., alkaline phosphatase, horseradish peroxidase, beta-galactosidase and/or angiogenin), co-factors, peptide moieties (e.g., a HIS-tag), proteins (e.g. lectin, serum albumin), carbohydrates (e.g., mannose-6-phosphate tags), fluorophores (e.g., fluorescein isothiocyanate (FITC)), phycoerythrin, green/blue/red or other fluorescent proteins, allophycocyanin (APC), chromophores, vitamins (e.g., biotin), chelators, antimetabolites (e.g., methotrexate), toxins (e.g. a cytotoxic drug, or a radiotoxin).

In one aspect, the invention relates to drug conjugates (in particular antibody-drug conjugates ADCs) comprising the antigen binding proteins described herein conjugated to a toxin which further enhances efficient killing of specific cells, such as e.g., MAGE-A4 positive cells. The toxin moiety is typically a small molecular weight moiety, such as anthracycline toxins, taxol, gramicidin D and/or colchicine which may be linked via a peptide linker to the antigen binding protein.

The toxin may be conjugated non-site-specifically or site-specifically to the antigen binding protein. Non-site-specific conjugation typically involves the use of chemical linkers, e.g., with maleimide functionality, that mediate conjugation to lysine or cysteine amino acid side chains of the antibody. Site-specific conjugation may be achieved using chemical, chemo-enzymatic, or enzymatic conjugations known in the art, e.g., employing bifunctional linkers, bacterial transglutaminase or sortase enzymes, linkers allowing Pictet-Spengler chemistry on formyl-glycine forming enzyme modified antigen binding proteins, or glycan-remodeled antigen binding proteins.

Chimeric Antigen Receptors

In one aspect, the disclosure provides chimeric antigen receptors (CARs) and immune cells engineered to express such CARs, comprising the antigen binding proteins described herein. As used herein, the term "chimeric antigen receptor" or "CAR" refers to a receptor that is capable of activating an immune cell in response to antigen binding. CARs are recombinant membrane spanning molecules and are advantageously expressed on immune cells. Their structure typically comprises (i) an extracellular domain (ectodomain or antibody domain), (ii) a transmembrane domain and (iii) a cytoplasmic domain (endodomain or intracellular signaling domain).

The ectodomain (i.e., antibody domain) typically comprises a scFv but other antigen binding proteins may also be used. A spacer connects the ectodomain and the transmembrane domain, which in turn is connected to an endodomain. Upon binding of the ectodomain to the antigen, the receptors cluster and an activation signal is transmitted to the cell which results in initiation of an immune response. First generation CARs have a simply structured endodomain comprising CD3-zeta. To increase the activation signal, a co-stimulatory domain was added in the second-generation CARs; and third generation CARs include two or more co-stimulatory domains (Maus M V et al (2014) Blood, 123: 2625-2635). Said co-stimulatory domains may be selected from the group consisting of CD28, OX40 and/or 4-1BB. Apart from CD3-zeta, other ITAM-containing domains have been explored including the Fc receptor for IgE-γ domain.

Suitable immune cells include, without being limited to, T cells, Natural Killer T (NKT) cells, natural killer (NK) cells, human embryonic stem cells, hematopoietic stem cells (HSC) or induced pluripotent stem cells (iPS). Such T cell may be a cytotoxic T lymphocyte (CTL), a regulatory T lymphocyte, an inflammatory T-lymphocytes, or a helper T-lymphocyte or a gamma-delta T cell. The T cell may be a CD4+ or CD8+ or a mixed population of CD4+ and CD8+ cells.

In one aspect, the disclosure provides a chimeric antigen receptor (CAR) that specifically recognizes a peptide-MHC, comprising: i) an antigen binding protein with specificity to a MAGE-A4 peptide-MHC; ii) a transmembrane domain; and iii) an intracellular signaling domain.

In certain embodiments, the transmembrane domain is selected from the group consisting of an artificial hydrophobic sequence and transmembrane domains of a type I transmembrane protein, an alpha, beta or zeta chain of a T cell receptor, CD28, CD3 epsilon, CD45, CD4, CD5, CD8, CD9, CD16, CD22, CD33, CD37, CD64, CD80, CD86, CD134, CD137, and CD154.

In certain embodiments, the intracellular signaling domain is selected from the group consisting of cytoplasmic signaling domains of a human CD3 zeta chain, FcγRIII, a cytoplasmic tail of an Fc receptor, an immunoreceptor tyrosine-based activation motif (ITAM) bearing cytoplasmic receptors, TCR zeta, FcR gamma, FcR beta, CD3 gamma, CD3 delta, CD3 epsilon, CD5, CD22, CD79a, CD79b, and CD66d.

The antibody domain may be any of the antigen binding proteins outlined above. Thus, in certain embodiments, the antibody domain comprises an antibody variable light domain (VL) comprising an amino acid sequence represented by the formula LFR1-CDRL1-LFR2-CDRL2-LFR3-CDRL3-LFR4. In certain embodiments, the antibody domain comprises an antibody variable heavy domain (VH) comprising an amino acid sequence represented by the formula HFR1-CDRH1-HFR2-CDRH2-HFR3-CDRH3-HFR4. In certain embodiments, the antibody domain comprises an scFv as described herein.

Methods of Administering Antigen Binding Proteins

Methods of preparing and administering antigen binding proteins of the disclosure as well as the nucleic acids described herein, the vectors described herein, the host cell cells described herein (in particular the immune cells bearing a CAR) or the compositions described herein to a subject are well known to or are readily determined by those skilled in the art. The route of administration of the antigen binding proteins of the current disclosure may e.g., be oral, parenteral, by inhalation, or topical. The term parenteral as used herein includes intravenous, intraarterial, intraperitoneal, intramuscular, subcutaneous, rectal or vaginal administration. The term intraocular as used herein includes, but is not limited to, subconjunctival, intravitreal, retrobulbar, or intracameral. The term topical as used herein includes, but is not limited to, administration with liquid or solution eye drops, emulsions (e.g., oil-in-water emulsions), suspensions, and ointments.

While all these forms of administration are clearly contemplated as being within the scope of the current disclosure, a form for administration would be a solution for injection. Usually, a suitable pharmaceutical composition for injection may comprise a buffer (e.g., acetate, phosphate or citrate buffer), a surfactant (e.g., polysorbate), optionally a stabilizer agent (e.g., human albumin), etc. However, in other methods compatible with the teachings herein, the modified antibodies can be delivered directly to the site of the adverse cellular population thereby increasing the exposure of the diseased tissue to the therapeutic agent.

Effective doses of the compositions of the present disclosure, for the treatment of the related conditions vary depending upon many different factors, including means of administration, target site, physiological state of the patient, whether the patient is human or an animal, other medications administered, and whether treatment is prophylactic or therapeutic. Usually, the patient is a human, but non-human mammals, including transgenic mammals, can also be treated. Treatment dosages may be titrated using routine methods known to those of skill in the art to optimize safety and efficacy.

As previously discussed, the antigen binding proteins of the present disclosure, conjugates or recombinants thereof may be administered in a pharmaceutically effective amount for the in vivo treatment of mammalian disorders. In this regard, it will be appreciated that the disclosed antigen binding proteins will be formulated to facilitate administration and promote stability of the active agent.

Pharmaceutical compositions in accordance with the present disclosure typically include a pharmaceutically acceptable, non-toxic, sterile carrier such as physiological saline, nontoxic buffers, preservatives and the like. For the purposes of the instant application, a pharmaceutically effective amount of the antigen binding proteins shall be held to mean an amount sufficient to achieve effective binding to an antigen and to achieve a benefit, e.g., to ameliorate symptoms of a disease or disorder or to detect a substance or a cell. In the case of tumor cells, the antigen binding proteins will typically be capable of interacting with selected immunoreactive antigens on neoplastic or immunoreactive cells and provide for an increase in the death of those cells. Of course, the pharmaceutical compositions of the present disclosure may be administered in single or multiple doses to provide for a pharmaceutically effective amount of the modified binding polypeptide.

In keeping with the scope of the present disclosure, the antigen binding proteins of the disclosure may be administered to a human or other animal in accordance with the aforementioned methods of treatment in an amount sufficient to produce a therapeutic or prophylactic effect. The antigen binding proteins of the disclosure can be administered to such human or other animal in a conventional dosage form prepared by combining the antigen binding proteins of the disclosure with a conventional pharmaceutically acceptable carrier or diluent according to known techniques. It will be recognized by one of skill in the art that the form and character of the pharmaceutically acceptable carrier or diluent is dictated by the amount of active ingredient with which it is to be combined, the route of administration and other well-known variables. Those skilled in the art will further appreciate that a cocktail comprising one or more species of antigen binding proteins described in the current disclosure may prove to be particularly effective. Similarly, the nucleic acids described herein, the vectors described herein, the host cell cells described herein (in particular the immune cells bearing a CAR) or the compositions described herein may be administered to a human or other animal in accordance with the methods of treatment described above in an amount sufficient to produce a therapeutic or prophylactic effect.

"Efficacy" or "in vivo efficacy" as used herein refers to the response to a therapy by the pharmaceutical composition of the disclosure, using e.g., standardized response criteria, such as standard ophthalmological response criteria. The success or in vivo efficacy of the therapy using a pharmaceutical composition of the disclosure refers to the effectiveness of the composition for its intended purpose, i.e., the ability of the composition to cause its desired effect. The in vivo efficacy may be monitored by established standard methods for the specific diseases. In addition, various disease specific clinical chemistry parameters and other established standard methods may be used.

In some embodiments, the compounds and cells described herein are administered in combination with one or more different pharmaceutical compounds. Generally, therapeutic use of the compounds and cells described herein may be in combination with one or more therapies selected from the group of antibody therapy, chemotherapy, cytokine therapy, dendritic cell therapy, gene therapy, hormone therapy, laser light therapy, radiation therapy or vaccine therapy.

Methods of Treating MAGE-A4-Mediated Diseases and Disorders

In one aspect, the aforementioned antigen binding proteins, nucleic acids, vectors or host cells (in particular immune cells expressing CARs) or the vector, are useful as a medicament. Typically, such a medicament includes a therapeutically effective amount of a molecule or cell as provided herein. Accordingly, a respective molecule or host cell can be used for the production of a medicament useful in the treatment of one or more disorders, in particular MAGE-A4 related disorders.

In one aspect, a method of treating a MAGE-A4 related or mediated disorder is provided. The method includes the steps of administering a pharmaceutically effective amount of a molecule or host cell as described herein, in particular the antigen binding proteins or host cell, to a subject in need thereof. In one embodiment, the pharmaceutical composition described above, which includes such pharmaceutically effective amount of the antigen binding protein, nucleic acid, vector or host cell is administered to the subject. The medicament referred to above may be administered to a subject.

In another aspect, the disclosure provides a method of treating a MAGE-A4 pMHC-expressing cancer in a patient in need thereof comprising administering to the patient a therapeutically effective amount of the antigen binding protein recited above or the pharmaceutical composition recited above.

In certain embodiments, the method further comprises administering an immune checkpoint inhibitor.

In certain embodiments, the immune checkpoint inhibitor is selected from the group consisting of an anti-CTLA-4 antibody, an anti-PD-L1 antibody, an anti-PD-1 antibody, an anti-TIM-3 antibody, an anti-LAG-3 antibody, an anti-BTLA antibody, an anti-VISTA antibody, and combinations thereof.

The subject in need of a treatment can be a human or a non-human animal. Typically, the subject is a mammal, e.g., a mouse, a rat, rabbit, a hamster, a dog, a cat, a monkey, an ape, a goat, a sheep, a horse, a chicken, a guinea pig or a pig. In typical embodiments, the subject is diagnosed with a MAGE-A4 related disorder or may acquire such a disorder. In case of an animal model, the animal might be genetically engineered to develop a MAGE-A4 related disorder. In an animal model, an animal may also be genetically engineered in such a way that it shows the characteristics of MAGE-A4 related disease.

In certain embodiments, the MAGE-A4-mediated disease or disorder is selected from a group consisting of melanoma, head and neck cancer, ovarian cancer, testicular cancer, T cell leukemia/lymphoma (e.g., ATLL), bladder cancer and esophagus cancer. The invention also relates to an antigen binding protein as disclosed herein for use in a method of treating a MAGE-A4-mediated disease or disorder in a subject, in particular cancer. All the technical features described in the present disclosure regarding the antigen binding proteins are applicable.

Use in Diagnostics and Detection Assays

A antigen binding protein as disclosed herein may be used for detection or diagnostic purposes in vivo and/or in vitro. For example, a wide range of immunoassays using antibodies for detecting the expression in specific cells or tissues are known to the skilled person. For such purposes, it may be advantageous to use a antigen binding protein connected to a detectable label, such a biotin.

In one embodiment, the described antigen binding proteins are useful for detecting the presence of a target peptide-MHC complex, in particular MAGE-A4, in a sample. The detection may be for quantitative or qualitative purposes. The sample is preferably of biological origin, such as blood, urine, cerebrospinal fluid, biopsy, lymph and/or non-blood tissues. In certain embodiments, a biological sample comprises a cell or tissue from a human patient. In certain embodiments, the method includes contacting a biological sample with an antigen binding protein under conditions permissive for binding of the inhibitor to the target peptide-MHC and then detecting the inhibitor-target complex. Such method may be an in vitro or in vivo method. In some embodiments, such method is performed to select subjects eligible for therapy with the antigen binding protein described herein.

Kits

Also contemplated are kits comprising at least one nucleic acid library or antigen binding protein as described herein, typically together with a packaged combination of reagents with instructions. In one embodiment, the kit includes a composition containing an effective amount of said antigen binding protein in unit dosage form. Such kit may comprise a sterile container comprising the composition; non-limiting examples of such containers include, without being limited to, vials, ampoules, bottles, tubes, syringes, blister-packs. In some embodiments, the composition is a pharmaceutical composition and the containers is made of a material suitable for holding medicaments. In one embodiment, the kit may comprise in a first container the antigen binding protein in lyophilized form and a second container with a diluent (e.g., sterile water) for reconstitution or dilution of the antigen binding protein. In some embodiments, said diluent is a pharmaceutically acceptable diluent. In one embodiment, the kit is for diagnostic purposes and the antigen binding protein is formulated for diagnostic applications. In one embodiment, the kit is for therapeutic purposes and the antigen binding protein is formulated for therapeutic applications.

Typically, the kit will further comprise a separate sheet, pamphlet or card supplied in or with the container with instructions for use. If the kit is intended for pharmaceutical use, it may further comprise one or more of the following: information for administering the composition to a subject having a related disease or disorder (e.g., a MAGE-A4-mediated disease or disorder) and a dosage schedule, description of the therapeutic agent, precautions, warnings, indications, counter-indications, overdosage information and/or adverse reactions.

It will be readily apparent to those skilled in the art that other suitable modifications and adaptations of the methods described herein may be made using suitable equivalents without departing from the scope of the embodiments disclosed herein. Having now described certain embodiments in detail, the same will be more clearly understood by reference to the following examples, which are included for purposes of illustration only and are not intended to be limiting.

EXAMPLES

Example 1—Production of MHC Complexes as an Antigen for Immunization

MHC class I heavy chain and β2m were cloned into a pET-24D(+) vector using standard molecular biology techniques (J Biol Chem. 1995 Jan. 13; 270(2):971-7). E. coli BL-21 (DE3) were transformed with the expression vectors according to the supplier's protocols. Protein expression was performed for 16-18 hours at 37° C. with 220 rpm shaking in MagicMedium (Invitrogen), as described by the supplier. Cells were harvested and lysed with BugBuster (Invitrogen) and the inclusion bodies were washed twice with TBS supplemented with 0.5% LDAO and twice with TBS. Such prepared inclusion bodies were solubilized in a denaturing buffer (8 M urea, 100 mM Tris-HCl pH 8) using 5 mL buffer per 1 g inclusion body pellet. Refolding and purification of the MHC with the target peptides (HLA-A*02:01 extracellular domain, human β2M, and MAGE-A4 peptide 230-239) was performed essentially as described by Rodenko et al. (2006). The amino acid sequences for each component of the pMHC antigen are recited below in Table 2.

TABLE 2

Amino Acid Sequences Of pMHC Antigen Components

| Sequence ID | Sequence |
|---|---|
| HLA-A*02:01 extracellular domain SEQ ID NO: 1 | GSHSMRYFFTSVSRPGRGEPRFIAVGYVDDTQFV RFDSDAASQRMEPRAPWIEQEGPEYWDGETRKV KAHSQTHRVDLGTLRGYYNQSEAGSHTVQRMY GCDVGSDWRFLRGYHQYAYDGKDYIALKEDLR SWTAADMAAQTTKHKWEAAHVAEQLRAYLEG TCVEWLRRYLENGKETLQRTDAPKTHMTHHAV SDHEATLRCWALSFYPAEITLTWQRDGEDQTQD TELVETRPAGDGTFQKWAAVVVPSGQEQRYTCH VQHEGLPKPLTLRWE |
| human β2m SEQ ID NO: 2 | IQRTPKIQVYSRHPAENGKSNFLNCYVSGFHPSDI EVDLLKNGERIEKVEHSDLSFSKDWSFYLLYYTE FTPTEKDEYACRVNHVTLSQPKIVKWDRDM |
| MAGE-A4$_{230-239}$ SEQ ID NO: 3 | GVYDGREHTV |

Example 2—Rabbit Immunization

To generate numerous antibodies able to specifically recognize the target peptides in the context of the HLA complex, 3 New Zealand white rabbits were immunized with the recombinantly produced MHC complex. Each animal received at different timepoints 4 injections of the pMHC complex with complete or incomplete Freund's adjuvant. The immune response of the animals was tested in ELISA to quantify anti-pMHC antibodies present in serum samples of the immunized animals. Antibody titers in sera indicated excellent immune responses.

Example 3—Construction of Immune Libraries Derived From Rabbits scFv antibody cDNA libraries were constructed from the RNA extracted from isolated PBMCs and spleen lymphocytes from rabbits via PCR amplification. Coding sequences for the variable light- and heavy-domain were amplified separately and linked through a series of overlap polymerase chain reaction (PCR) steps to give the final scFv products. The amplified DNA sequences coding for the scFvs from rabbits were digested using appropriate restriction enzymes and were subsequently ligated into the phagemid vectors. The phagemid vectors were transformed into E. coli TG1 electrocompetent cells which are well suited for antibody phage display library creation. These processes resulted in two antibody libraries comprising a diversity of $5.2 \times 10^8$ with a sequence accuracy of 87.5% for the kappa based library and $2.0 \times 10^9$ with an accuracy of 91.7% for the lambda based library.

Example 4—Alignment of the Kappa Light Chain Alleles 68 rabbit kappa light chain alleles are listed in the IMGT database. The DNA sequences of all 68 alleles were exported and aligned. Only 4 out of the 68 alleles do not have a cysteine at position 80 (according to Kabat numbering), which underlines the importance of optimizing scFv immune libraries comprising the rabbit kappa light chain repertoire. The nucleotide sequence in this cysteine flanking region shows a high sequence conservation. This allows the design of a primer set which covers the complete naïve rabbit kappa light chain repertoire. The alignment of the sequences is shown in FIG. 1.

Example 5—Design of Primers

Primers were designed to mutate the cysteine at position 80 in rabbit kappa light chains into an alanine. Two forward primers were designed comprising the nucleotide substitution C80A. In addition, 10 reverse primers are required to cover the full kappa light chain repertoire. See Table 3 below. Primer design was done according to Q5 site directed protocol of New England Biolabs.

TABLE 3

Primer sets used to remove the cysteine 80, comprising 2 forward primers and 10 reverse primers. This set of primers is meant to cover the full naïve rabbit Vκ repertoire.

| Primer | Sequence (5' to 3') | Tm |
|---|---|---|
| forward_1 (F1) SEQ ID NO: 4 | GCTGACGATGCTGCCAC | 62 °C. |
| forward_2 (F2) SEQ ID NO: 5 | GCTGCCGATGCTGCC | 63 °C. |
| reverse_1 (R1) SEQ ID NO: 6 | CTCCACGCCACTGATG | 63 °C. |
| reverse_2 (R2) SEQ ID NO: 7 | CTGTACGCCACTGATGG | 63 °C. |
| reverse_3 (R3) SEQ ID NO: 8 | CTGCACACCGCTGATG | 64 °C. |
| reverse_4 (R4) SEQ ID NO: 9 | CTGCACGCCGCTG | 65 °C. |
| reverse_5 (R5) SEQ ID NO: 10 | CTGCACGCCACTGATG | 64 °C. |
| reverse_6 (R6) SEQ ID NO: 11 | CTGCACGCCGTTGATG | 65 °C. |
| reverse_7 (R7) SEQ ID NO: 12 | CTCCAGGTCGCTGATGG | 65 °C. |
| reverse_8 (R8) SEQ ID NO: 13 | CTGTGCACCGCTGATG | 64 °C. |
| reverse_9 (R9) SEQ ID NO: 14 | CTGCACGTCGCTGATG | 64 °C. |
| reverse_10 (R10) SEQ ID NO: 15 | CTGCACACCACTGATGG | 63 °C. |

Figure 2:
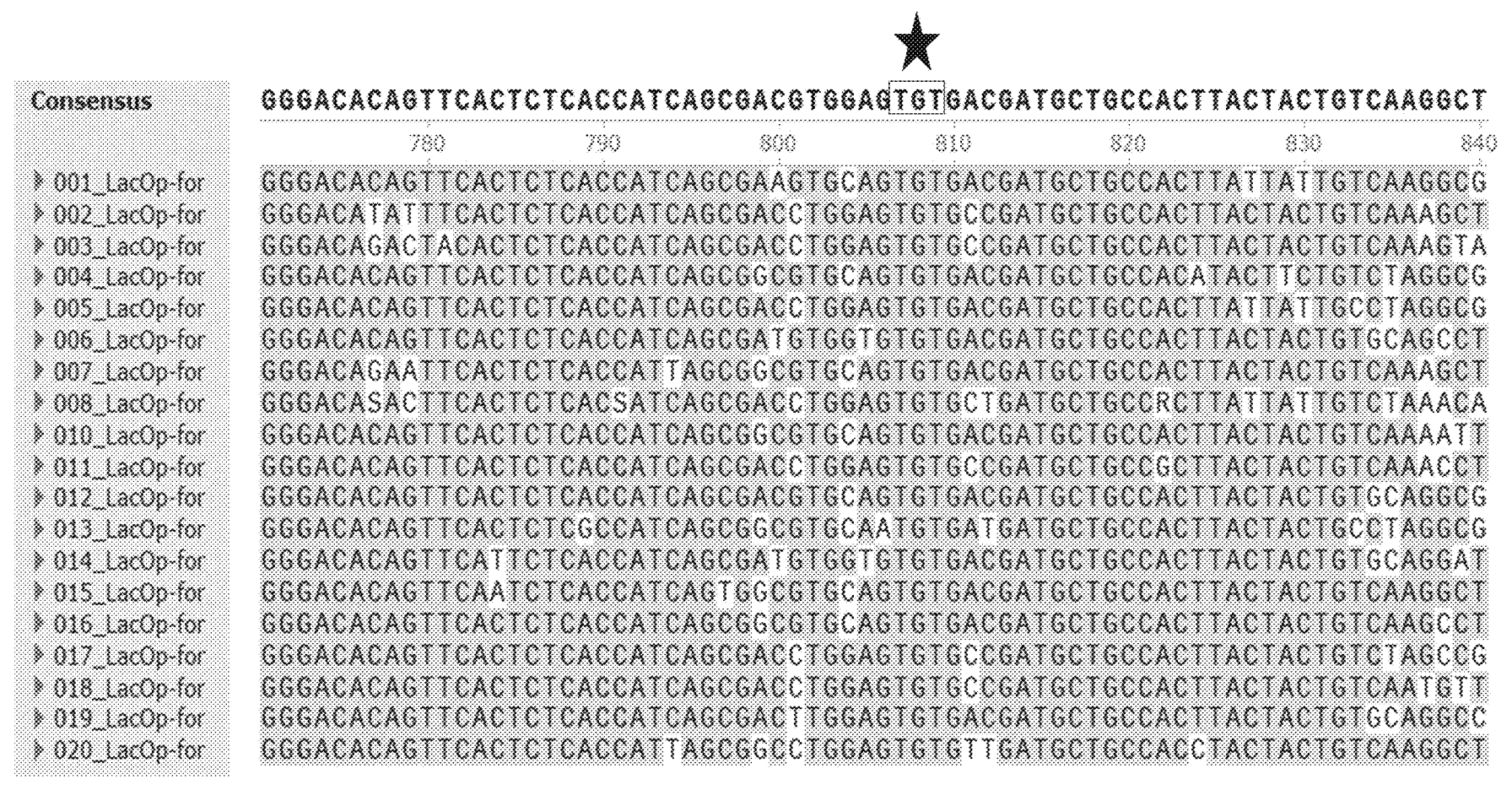

For a proof of concept, 20 clones of an in-house rabbit immune library were randomly picked. These variants have been sequenced and aligned against the naïve rabbit kappa light chains repertoire (IMGT database). Sequence alignment of the matured antibodies are listed in FIG. 2. Based on these antibodies, which have gone through the somatic hypermutation process, as well as the sequence rearrangement within the immune response of the rabbits, have been used to assess the designed primer set for its functionality of mutating an immune library repertoire while recovering a high diversity.

Within the 20 sequences which have been selected, 1/20 showed poor sequence quality. Of the 19 remaining sequences, 11/19 (58%) were fully covered by the primer set without any mismatches. From the remaining variants, 5/19 (26%) revealed 1 nucleotide mismatch in either the forward or the reverse primer. The other 3/19 (16%) showed two or three mismatches. With the assumption that a PCR would potentially still work for those with only 1 mismatch in the primer annealing region, a library recovery of 16/19 (84%) was found.

Example 6—Optimization of an In-House Rabbit scFv Immune Library

The DNA (Phagemid) of an in-house rabbit scFv immune library was used as template DNA to run all possible primer combinations of the explained primer set (20 PCR reactions). The Q5 Site-Directed Mutagenesis kit of New England Biolabs was used according to the provided protocol. The annealing temperature was set to 63° C. and 35 cycles were used with 1 ng of the original phagemid DNA as template. After PCR, the KLD reaction (a part of the Q5 Site-Directed Mutagenesis protocol) was done for each sample with incubating for 30 min at room temperature, followed by 30 min at 16° C. The KLD reactions were then purified using PCR purification followed by electroporation into TG1 cells. The transformed bacteria were plated on 2×YT plates containing 100 µg/ml ampicillin+1% glucose and incubated overnight at 37° C. After harvesting the bacteria, the phage amplification was initiated according to standard protocols. In addition, a serial dilution of bacteria was performed to determine the transformation titers which was indicating a library coverage of 8.5-fold above the original library. A few clones of each reaction were sequenced for quality control.

Example 7—Quality of Optimized Library

Each of the 20 PCR reactions (96 in total) were sequenced to check the quality of the optimized library. For all PCR reactions, there were successfully optimized variants available. Overall, 64/96 (67%) correct insert with the foreseen substitution C80A were identified. The remaining 32 sequences exhibit different problems such as frameshifts, sequencing problems, and primer mismatches. Combined with the diversity of the original library of 8.5-fold within the bacteria transformation readout from which a correct insert percentage of 67% was identified, an overall library coverage of around 6-fold was determined.

Figure 3:
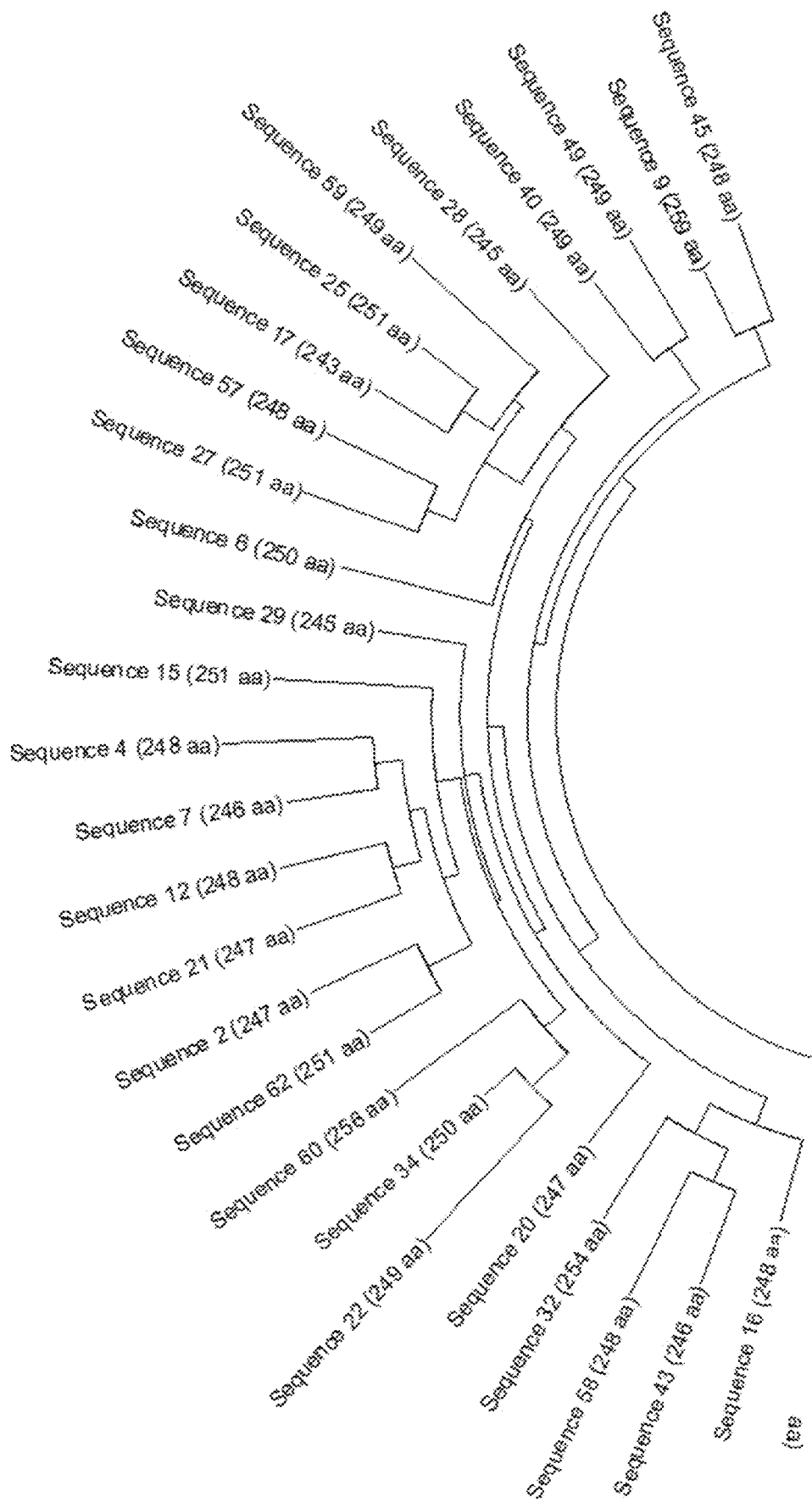
FIG. 3 depicts the phylogenetic tree of 62 sequences from the optimized rabbit immune library. A high coverage of the sequence diversity is depicted.
Figure 3:
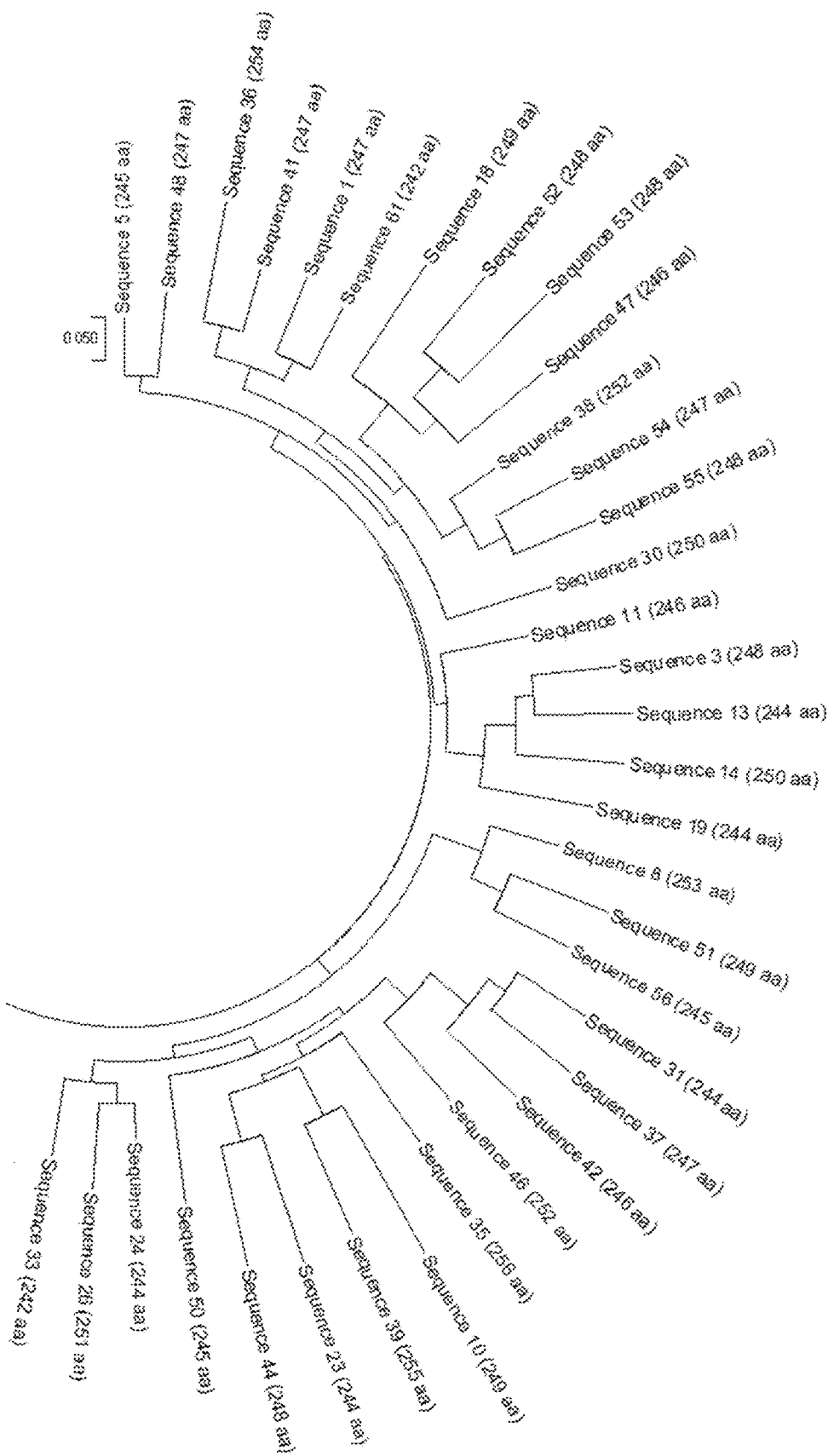

In addition, the sequenced variants (64/96) were further analyzed by designing a phylogenetic circle which indicated a good distribution of different rabbit kappa light chain subtypes, as shown in FIG. 3.

Example 8—Biopanning with Optimized Library

The optimized in-house rabbit scFv immune library was used for biopanning against the specific pMHC target. In parallel, the original rabbit scFv immune library has been used as direct control for the quality and efficacy of the optimized library. Three rounds of phage display were performed, before the libraries were screened for specific hits. Screening was done with a monoclonal phage ELISA against specific and unspecific target. The ratio of the signal from the specific target binding to the unspecific binding was then calculated to find hits binding specifically to the target. The data can be found in Table 4 (original rabbit library) and Table 5 (optimized library).

Specifically, Table 4 and Table 5 show the output of the monoclonal phage ELISA after three rounds of biopanning applied to the rabbit derived antibody library in which the Cys80 was removed. The values indicate the binding signal ratios to target peptide MAGE-A4 in context of the HLA complex/mix of 49 different unrelated peptides (SEQ ID NOs: 345-393, as recited in Table 9) in context of the HLA complex. Ratios higher than 2.5 are highlighted in grey, each data point represents one phage displayed clone.

Whereas for the original library after three rounds of biopanning only one binder could be identified, there are 13 binders found in the optimized library. This clearly shows the evidence of removing the free cysteine to use the full diversity from the rabbit immunization libraries.

Additional rounds of panning have been executed by using the lambda library and the optimized kappa library. 19 unique and target specific antibodies were identified. The 19 antibody scFv sequences identified in the biopanning screen are recited below in Table 6.

TABLE 4

Output of the panning of the phage display rabbit antibodies with Cys80. Original rabbit library. Each data point A1-H12 represents on clone after three rounds of biopanning in a monoclonal phage ELISA for binding against HLA-A2/MAGE-A4 complex in relation to unspecific binding against HLA complex/mix of 49 different unrelated peptides (SEQ ID NOs: 345-393, as recited in Table 9). Ratios higher than 2.5 are highlighted in bold text.

|   | 1 | 2 | 3 | 4 | 5 | 6 | 7 | 8 | 9 | 10 | 11 | 12 |
|---|---|---|---|---|---|---|---|---|---|----|----|----|
| A | 0.89 | 0.97 | 1.00 | 0.89 | 0.96 | 0.89 | 0.89 | 0.75 | 0.90 | 0.75 | 0.86 | 0.56 |
| B | 0.71 | 0.97 | 0.95 | 0.65 | 0.75 | 0.94 | 0.83 | 0.96 | 0.72 | 1.00 | 0.93 | 0.63 |
| C | 0.74 | 0.66 | 0.67 | 0.90 | 0.80 | 0.78 | 0.61 | 1.11 | 0.82 | 0.81 | 0.85 | 0.77 |
| D | 0.56 | 0.76 | 0.76 | 0.64 | 0.69 | 0.71 | 1.05 | 0.82 | 0.80 | 0.76 | 0.65 | 0.65 |
| E | 0.86 | 0.59 | 1.11 | 0.64 | 0.88 | 1.02 | 1.06 | 0.59 | 0.96 | 0.84 | 1.07 | 1.06 |
| F | 0.79 | 0.68 | 0.72 | 1.04 | 0.49 | 0.64 | 1.06 | 0.68 | 1.13 | 0.62 | 0.70 | 0.68 |
| G | 0.54 | 0.88 | 3.04 | 0.51 | 0.94 | 0.92 | 0.57 | 0.57 | 0.69 | 0.65 | 0.60 | 0.70 |
| H | 0.57 | 0.71 | 0.54 | 0.60 | 0.47 | 0.39 | 0.53 | 0.93 | 0.90 | 0.54 | 0.88 | 1.13 |

TABLE 5

Output of the panning of the phage display rabbit antibodies with Cys80. Optimized library. Each data point A1-H11 represents on clone after three rounds of biopanning in a monoclonal phage ELISA for binding against HLA-A2/MAGE-A4 complex in relation to unspecific binding against HLA complex/mix of 49 different unrelated peptides. Ratios higher than 2.5 are highlighted in bold text. H12 represents a positive control.

|   | 1 | 2 | 3 | 4 | 5 | 6 | 7 | 8 | 9 | 10 | 11 | 12 |
|---|---|---|---|---|---|---|---|---|---|----|----|----|
| A | 0.73 | 0.94 | 0.67 | 0.80 | 0.94 | 11.64 | 0.83 | 0.95 | 15.58 | 0.99 | 1.73 | 12.60 |
| B | 0.88 | 10.18 | 11.26 | 0.75 | 0.87 | 22.48 | 1.13 | 10.85 | 0.94 | 1.02 | 0.88 | 0.94 |
| C | 0.97 | 0.27 | 0.65 | 0.89 | 0.89 | 0.89 | 3.74 | 0.87 | 0.84 | 0.76 | 0.97 | 1.11 |
| D | 0.95 | 0.83 | 0.90 | 0.94 | 17.06 | 0.70 | 0.97 | 0.87 | 0.70 | 19.62 | 0.96 | 1.02 |
| E | 0.86 | 0.94 | 0.75 | 0.60 | 0.84 | 0.88 | 0.67 | 0.92 | 0.89 | 0.57 | 0.76 | 11.32 |
| F | 0.53 | 0.92 | 0.96 | 2.66 | 0.95 | 1.81 | 0.64 | 0.92 | 12.50 | 0.98 | 0.94 | 0.76 |
| G | 0.97 | 0.96 | 0.93 | 0.92 | 0.68 | 0.56 | 1.67 | 0.71 | 0.73 | 0.81 | 0.68 | 0.62 |
| H | 1.12 | 0.75 | 0.82 | 0.60 | 0.95 | 0.93 | 0.59 | 0.92 | 0.80 | 0.74 | 0.91 | 4.51 |

TABLE 6

Rabbit-Derived Antibody Amino Acid Sequences. CDR sequences are highlighted in bold underlined text.

| Antibody ID | Sequence |
|---|---|
| M0848 scFV<br>SEQ ID NO: 16 | QEQLVESGGGLVTPGTPLTLTCTVSGFSLSSYAMGWVRQ APGKGLEWIGTINDGGTAFYASWVKGRFTISRTSTTVDLR VTSPTTEDTATYFCARAYGSNGDVYWGYFNLWGQGTLV TVSSGGGGSGGGGSGGGGSGGGGASELDLTQTPASVEVA VGGTVTIKCQASQSIGSYLSWYQQKPGQRPKLLIFRASTL ASGVSSRFKGSGSGTQFTLTISGVECADAATYYCQQGYSS TNLDNVFGGGTEVVVK |
| M0848 VH<br>SEQ ID NO: 17 | QEQLVESGGGLVTPGTPLTLTCTVSGFSLSSYAMGWVRQ APGKGLEWIGTINDGGTAFYASWVKGRFTISRTSTTVDLR VTSPTTEDTATYFCARAYGSNGDVYWGYFNLWGQGTLV TVSS |
| M0848 VL<br>SEQ ID NO: 18 | ELDLTQTPASVEVAVGGTVTIKCQASQSIGSYLSWYQQKP GQRPKLLIFRASTLASGVSSRFKGSGSGTQFTLTISGVECA DAATYYCQQGYSSTNLDNVFGGGTEVVVK |
| M0848 CDRH1<br>SEQ ID NO: 19 | SSYAMG |

TABLE 6-continued

Rabbit-Derived Antibody Amino Acid Sequences. CDR sequences are highlighted in bold underlined text.

| Antibody ID | Sequence |
| --- | --- |
| M0848 CDRH2 SEQ ID NO: 20 | TINDGGTAFYASWVKG |
| M0848 CDRH3 SEQ ID NO: 21 | AYGSNGDVYWGYFNL |
| M0848 CDRL1 SEQ ID NO: 22 | QASQSIGSYLS |
| M0848 CDRL2 SEQ ID NO: 23 | RASTLAS |
| M0848 CDRL3 SEQ ID NO: 24 | QQGYSSTNLDNV |
| M0849 scFv SEQ ID NO: 25 | QEQLEESGGGLVTPGGTLTLTCTVSGFSLSNYAMGWVRQ APGKGLEWIGTINDGGTAFYAKWLKGRFTISRTSTTVDL KITSPTTEDTATYFCARAYGSNGDVYWGYFNLWGQGTL VTISSGGGGSGGGGSGGGGSGGGGASELVMTQTPSSVSEP VGGTVTIKCQASQSIGSNLAWYQQRPGQPPKLLIYSASTL ASGVSSRFKGSGSGTESTLTISGVQAADAATYYCQQGYSS SNVDNVFGGGTELEIL |
| M0849 VH SEQ ID NO: 26 | QEQLEESGGGLVTPGGTLTLTCTVSGFSLSNYAMGWVRQ APGKGLEWIGTINDGGTAFYAKWLKGRFTISRTSTTVDL KITSPTTEDTATYFCARAYGSNGDVYWGYFNLWGQGTL VTISS |
| M0849 VL SEQ ID NO: 27 | ELVMTQTPSSVSEPVGGTVTIKCQASQSIGSNLAWYQQRP GQPPKLLIYSASTLASGVSSRFKGSGSGTESTLTISGVQAA DAATYYCQQGYSSSNVDNVFGGGTELEIL |
| M0849 CDRH1 SEQ ID NO: 28 | SNYAMG |
| M0849 CDRH2 SEQ ID NO: 29 | TINDGGTAFYAKWLKG |
| M0849 CDRH3 SEQ ID NO: 30 | AYGSNGDVYWGYFNL |
| M0849 CDRL1 SEQ ID NO: 31 | QASQSIGSNLA |
| M0849 CDRL2 SEQ ID NO: 32 | SASTLAS |
| M0849 CDRL3 SEQ ID NO: 33 | QQGYSSSNVDNV |
| M0850 scFv SEQ ID NO: 34 | QEQLEESGGGLVTPGTPLTLTCTASGFSLSSYAMIWVRQA PGKGLEWIGTINDGGTAFYANWVKGRFTISRTSTTVDLK MTSPTTEDTATYFCARAYGSNGDVYWGYVNLWGQGTL VTVSSGGGGSGGGGSGGGGSGGGGASELVMTQTPASVSE PVGGTVTIKCQASQSIGSNLAWYQQKPGQPPKLLIYAAAN LASGVSSRFKGSRSGTEYTLTISGVQAADAATYYCQQGYS SSNVANVFGGGTELEIL |
| M0850 VH SEQ ID NO: 35 | QEQLEESGGGLVTPGTPLTLTCTASGFSLSSYAMIWVRQA PGKGLEWIGTINDGGTAFYANWVKGRFTISRTSTTVDLK MTSPTTEDTATYFCARAYGSNGDVYWGYVNLWGQGTL VTVSS |
| M0850 VL SEQ ID NO: 36 | ELVMTQTPASVSEPVGGTVTIKCQASQSIGSNLAWYQQKP GQPPKLLIYAAANLASGVSSRFKGSRSGTEYTLTISGVQAA DAATYYCQQGYSSSNVANVFGGGTELEIL |
| M0850 CDRH1 SEQ ID NO: 37 | SSYAMI |
| M0850 CDRH2 SEQ ID NO: 38 | TINDGGTAFYANWVKG |
| M0850 CDRH3 SEQ ID NO: 39 | AYGSNGDVYWGYVNL |

TABLE 6-continued

Rabbit-Derived Antibody Amino Acid Sequences. CDR sequences are highlighted in bold underlined text.

| Antibody ID | Sequence |
|---|---|
| M0850 CDRL1 SEQ ID NO: 40 | QASQSIGSNLA |
| M0850 CDRL2 SEQ ID NO: 41 | AAANLAS |
| M0850 CDRL3 SEQ ID NO: 42 | QQGYSSSNVANV |
| M0851 scFv SEQ ID NO: 43 | QEQLEESGGGLVTPGTPLTLTCTASGFSLSSYAMIWVRQAPGKGLEWIGTINDGGTAFYASWVKGRFTISRTSTTVDLKITSPTTEDTATYFCARAYGSNGDVYWGYVNLWGQGTLVTISSGGGGSGGGGSGGGGSGGGGASELVMTQTPSSVSAAVGGTVTINCQASQNIGSVFAWYQQKPGQPPKLLIYKASSLA SGVPSRFKGSGSGTQFTLTISGVEAADAATYYCQQGASSS NVDNIFGGGTEVVVK |
| M0851 VH SEQ ID NO: 44 | QEQLEESGGGLVTPGTPLTLTCTASGFSLSSYAMIWVRQAPGKGLEWIGTINDGGTAFYASWVKGRFTISRTSTTVDLKITSPTTEDTATYFCARAYGSNGDVYWGYVNLWGQGTLVTISS |
| M0851 VL SEQ ID NO: 45 | ELVMTQTPSSVSAAVGGTVTINCQASQNIGSVFAWYQQKPGQPPKLLIYKASSLASGVPSRFKGSGSGTQFTLTISGVEAADAATYYCQQGASSSNVDNIFGGGTEVVVK |
| M0851 CDRH1 SEQ ID NO: 46 | SSYAMI |
| M0851 CDRH2 SEQ ID NO: 47 | TINDGGTAFYASWVKG |
| M0851 CDRH3 SEQ ID NO: 48 | AYGSNGDVYWGYVNL |
| M0851 CDRL1 SEQ ID NO: 49 | QASQNIGSVFA |
| M0851 CDRL2 SEQ ID NO: 50 | KASSLAS |
| M0851 CDRL3 SEQ ID NO: 51 | QQGASSSNVDNI |
| M0852 scFv SEQ ID NO: 52 | QQQLEESGGGLVTPGTPLTLTCTVSGFSLSNYAMGWVRQAPGKGLEWIGTINDGGTAFYANWLKGRFTISRTSTTVDLKITSPTTEDTATYFCARAYGSNGDVYWGYFNLWGQGTLVTVSSGGGGSGGGGSGGGGSGGGGASELVMTQTASPVSAAVGGTVTINCQASQSISSRSLSWYQQKPGQPPKLLIYEAS KLASGVPSRFSGSGSGTQFTLTISGVQADDAATYYCQQGY SSSNVDNVFGGGTEVVVK |
| M0852 VH SEQ ID NO: 53 | QQQLEESGGGLVTPGTPLTLTCTVSGFSLSNYAMGWVRQAPGKGLEWIGTINDGGTAFYANWLKGRFTISRTSTTVDLKITSPTTEDTATYFCARAYGSNGDVYWGYFNLWGQGTLVTVSS |
| M0852 VL SEQ ID NO: 54 | ELVMTQTASPVSAAVGGTVTINCQASQSISSRSLSWYQQKPGQPPKLLIYEASKLASGVPSRFSGSGSGTQFTLTISGVQADDAATYYCQQGYSSSNVDNVFGGGTEVVVK |
| M0852 CDRH1 SEQ ID NO: 55 | SNYAMG |
| M0852 CDRH2 SEQ ID NO: 56 | TINDGGTAFYANWLKG |
| M0852 CDRH3 SEQ ID NO: 57 | AYGSNGDVYWGYFNL |

TABLE 6-continued

Rabbit-Derived Antibody Amino Acid Sequences. CDR sequences are highlighted in bold underlined text.

| Antibody ID | Sequence |
|---|---|
| M0852 CDRL1<br>SEQ ID NO: 58 | QASQSISSRSLS |
| M0852 CDRL2<br>SEQ ID NO: 59 | EASKLAS |
| M0852 CDRL3<br>SEQ ID NO: 60 | QQGYSSSNVDNV |
| M0853 scFv<br>SEQ ID NO: 61 | QQQLVESGGGLVTPGTPLTLTCTVSGFSLSNYAMGWVRQ<br>APGKGLEWIGTINDGGTAFYANWLKGRFTISRTSTTVDL<br>KITSPTTEDTATYFCARAYGSNGDVYWGYFNLWGQGTL<br>VTVSSGGGGSGGGGSGGGGSGGGGASELVMTQTASPVSA<br>AVGGTVTINCQASQSISSRSLSWYQQKPGQPPKLLIYEAS<br>KLASGVPSRFSGSGSGTQFTLTISGVQADDAATYYCQQGY<br>SSSNVDNFGGGTEVVVK |
| M0853 VH<br>SEQ ID NO: 62 | QQQLVESGGGLVTPGTPLTLTCTVSGFSLSNYAMGWVRQ<br>APGKGLEWIGTINDGGTAFYANWLKGRFTISRTSTTVDL<br>KITSPTTEDTATYFCARAYGSNGDVYWGYFNLWGQGTL<br>VTVSS |
| M0853 VL<br>SEQ ID NO: 63 | ELVMTQTASPVSAAVGGTVTINCQASQSISSRSLSWYQQK<br>PGQPPKLLIYEASKLASGVPSRFSGSGSGTQFTLTISGVQA<br>DDAATYYCQQGYSSSNVDNFGGGTEVVVK |
| M0853 CDRH1<br>SEQ ID NO: 64 | SNYAMG |
| M0853 CDRH2<br>SEQ ID NO: 65 | TINDGGTAFYANWLKG |
| M0853 CDRH3<br>SEQ ID NO: 66 | AYGSNGDVYWGYFNL |
| M0853 CDRL1<br>SEQ ID NO: 67 | QASQSISSRSLS |
| M0853 CDRL2<br>SEQ ID NO: 68 | EASKLAS |
| M0853 CDRL3<br>SEQ ID NO: 69 | QQGYSSSNVDN |
| M0854 scFv<br>SEQ ID NO: 70 | QSVKESWGRLVTPGGSLTLTCTVSGIDLNNYAMGWVRQA<br>PGKGLEWIGTINNDGATYYPSWARGRFTISKTSTTVDLKI<br>TSPTTEDTATYFCARTYGSNGDVYWGYFNLWGQGTLVT<br>VSSGGGGSGGGGSGGGGSGGGGASALELTQTPASVEVAV<br>GGTVTINCQASQSIGGALNWYQQKSGQPPKLLIYLASTLA<br>SGVSSRFKGSGSGTQFTLTISGVEAADAATYYCQQGYSAS<br>NIDNAFGGGTEVVVK |
| M0854 VH<br>SEQ ID NO: 71 | QSVKESWGRLVTPGGSLTLTCTVSGIDLNNYAMGWVRQA<br>PGKGLEWIGTINNDGATYYPSWARGRFTISKTSTTVDLKI<br>TSPTTEDTATYFCARTYGSNGDVYWGYFNLWGQGTLVT<br>VSS |
| M0854 VL<br>SEQ ID NO: 72 | ALELTQTPASVEVAVGGTVTINCQASQSIGGALNWYQQK<br>SGQPPKLLIYLASTLASGVSSRFKGSGSGTQFTLTISGVEA<br>ADAATYYCQQGYSASNIDNAFGGGTEVVVK |
| M0854 CDRH1<br>SEQ ID NO: 73 | NNYAMG |
| M0854 CDRH2<br>SEQ ID NO: 74 | TINNDGATYYPSWARG |
| M0854 CDRH3<br>SEQ ID NO: 75 | TYGSNGDVYWGYFNL |
| M0854 CDRL1<br>SEQ ID NO: 76 | QASQSIGGALN |
| M0854 CDRL2<br>SEQ ID NO: 77 | LASTLAS |

TABLE 6-continued

Rabbit-Derived Antibody Amino Acid Sequences. CDR sequences are highlighted in bold underlined text.

| Antibody ID | Sequence |
|---|---|
| M0854 CDRL3 SEQ ID NO: 78 | QQGYSASNIDNA |
| M0855 scFv SEQ ID NO: 79 | QQQLEESGGGLVTPGTPLTLTCTVSGIDLSSYAMGWVRQ APGKGLEWIGTINDGGSAFYASWVKGRFTISRTSTTVDLK ITSPTAEDTATYFCAKTYGTNGDVYWGYFNLWGQGTLV TISSGGGGSGGGGSGGGGSGGGGASELVMTQTPASVSEPV GGTVTIKCQASQSIGSNLAWYQQKPGQPPKLLIYYESILA SGVPSRFSGSGSGTEYTLTISGAQADDAATYYCQQGYSSS NIDNAFGGGTEVVVK |
| M0855 VH SEQ ID NO: 80 | QQQLEESGGGLVTPGTPLTLTCTVSGIDLSSYAMGWVRQ APGKGLEWIGTINDGGSAFYASWVKGRFTISRTSTTVDLK ITSPTAEDTATYFCAKTYGTNGDVYWGYFNLWGQGTLV TISS |
| M0855 VL SEQ ID NO: 81 | ELVMTQTPASVSEPVGGTVTIKCQASQSIGSNLAWYQQKP GQPPKLLIYYESILASGVPSRFSGSGSGTEYTLTISGAQADD AATYYCQQGYSSNIDNAFGGGTEVVVK |
| M0855 CDRH1 SEQ ID NO: 82 | SSYAMG |
| M0855 CDRH2 SEQ ID NO: 83 | TINDGGSAFYASWVKG |
| M0855 CDRH3 SEQ ID NO: 84 | TYGTNGDVYWGYFNL |
| M0855 CDRL1 SEQ ID NO: 85 | QASQSIGSNLA |
| M0855 CDRL2 SEQ ID NO: 86 | YESILAS |
| M0855 CDRL3 SEQ ID NO: 87 | QQGYSSSNIDNA |
| M0856 scFv SEQ ID NO: 88 | QQQLEESGGGLVTPGTPLTLTCTVSGIDLSSYAMGWVRQ APGKGLEWIGTINDGGSAFYASWVKGRFTISRTSTTVDLK ITSPTAEDTATYFCAKTYGTNGDVYWGYFNLWGQGTLV TISSGGGGSGGGGSGGGGSGGGGASELVMTQTPASVSEPV GGTVTIKCQASQSIGSNLAWYQQKPGQPPKLLIYYESILA SGVPSRFSGSGSGTEYTLTISGAQADDAATYYCQQGYSSS NILNAFGGGTEVVVK |
| M0856 VH SEQ ID NO: 89 | QQQLEESGGGLVTPGTPLTLTCTVSGIDLSSYAMGWVRQ APGKGLEWIGTINDGGSAFYASWVKGRFTISRTSTTVDLK ITSPTAEDTATYFCAKTYGTNGDVYWGYFNLWGQGTLV TISS |
| M0856 VL SEQ ID NO: 90 | ELVMTQTPASVSEPVGGTVTIKCQASQSIGSNLAWYQQKP GQPPKLLIYYESILASGVPSRFSGSGSGTEYTLTISGAQADD AATYYCQQGYSSNILNAFGGGTEVVVK |
| M0856 CDRH1 SEQ ID NO: 91 | SSYAMG |
| M0856 CDRH2 SEQ ID NO: 92 | TINDGGSAFYASWVKG |
| M0856 CDRH3 SEQ ID NO: 93 | TYGTNGDVYWGYFNL |
| M0856 CDRL1 SEQ ID NO: 94 | QASQSIGSNLA |
| M0856 CDRL2 SEQ ID NO: 95 | YESILAS |
| M0856 CDRL3 SEQ ID NO: 96 | QQGYSSSNILNA |

TABLE 6-continued

Rabbit-Derived Antibody Amino Acid Sequences. CDR sequences are highlighted in bold underlined text.

| Antibody ID | Sequence |
|---|---|
| M0857 scFv SEQ ID NO: 97 | QQQLVESGGRLVTPGTPLTLTCTASGIDLNSNAMSWVRQGPGKGLEWIGDIWSGGYTDYASWAKGRFTISKTSTTVDLKMTSLTAADTATYFCARDRLAGDGVVDYDLWGQGTLVTISSGGGGSGGGGSGGGGSGGGGASELDMTQTPASVEVAVGGTVTIKCQASQNIYSNLAWYQQKPGQRPKLLIYGASTLASGVPSRFKGSGSGTEYTLTINGVQAADAATYYCQQGFSSSNVDNVFGGGTEVVVK |
| M0857 VH SEQ ID NO: 98 | QQQLVESGGRLVTPGTPLTLTCTASGIDLNSNAMSWVRQGPGKGLEWIGDIWSGGYTDYASWAKGRFTISKTSTTVDLKMTSLTAADTATYFCARDRLAGDGVVDYDLWGQGTLVTISS |
| M0857 VL SEQ ID NO: 99 | ELDMTQTPASVEVAVGGTVTIKCQASQNIYSNLAWYQQKPGQRPKLLIYGASTLASGVPSRFKGSGSGTEYTLTINGVQAADAATYYCQQGFSSSNVDNVFGGGTEVVVK |
| M0857 CDRH1 SEQ ID NO: 100 | NSNAMS |
| M0857 CDRH2 SEQ ID NO: 101 | DIWSGGYTDYASWAKG |
| M0857 CDRH3 SEQ ID NO: 102 | DRLAGDGVVDYDL |
| M0857 CDRL1 SEQ ID NO: 884 | QASQNIYSNLA |
| M0857 CDRL2 SEQ ID NO: 103 | GASTLAS |
| M0857 CDRL3 SEQ ID NO: 104 | QQGFSSSNVDNV |
| M0858 scFv SEQ ID NO: 105 | QSVEESGGRLVTPGTPLTLTCTVSGFSLSNYAMSWVRQAPGKGLEYIGIVSSGGTTYYASWAKGRFTISKTSTTVDLKITSPTTEDTATYFCAKDLYYGPTTYSAFNLWGQGTLVTVSSGGGGSGGGGSGGGGSGGGGASELVLTQPQSVSGSLGQTVSISCKRARNNIEDYYVHWYQQHPGRSPTIVIHKDDQRPSGVPDRFSGSIDSTSNSASLTITGLLAEDEADYFCQSFDNNANPVFGGGTQLTVTG |
| M0858 VH SEQ ID NO: 106 | QSVEESGGRLVTPGTPLTLTCTVSGFSLSNYAMSWVRQAPGKGLEYIGIVSSGGTTYYASWAKGRFTISKTSTTVDLKITSPTTEDTATYFCAKDLYYGPTTYSAFNLWGQGTLVTVSS |
| M0858 VL SEQ ID NO: 107 | ELVLTQPQSVSGSLGQTVSISCKRARNNIEDYYVHWYQQHPGRSPTIVIHKDDQRPSGVPDRFSGSIDSTSNSASLTITGLLAEDEADYFCQSFDNNANPVFGGGTQLTVTG |
| M0858 CDRH1 SEQ ID NO: 108 | SNYAMS |
| M0858 CDRH2 SEQ ID NO: 109 | IVSSGGTTYYASWAKG |
| M0858 CDRH3 SEQ ID NO: 110 | DLYYGPTTYSAFNL |
| M0858 CDRL1 SEQ ID NO: 111 | KRARNNIEDYYVH |
| M0858 CDRL2 SEQ ID NO: 112 | KDDQRPS |
| M0858 CDRL3 SEQ ID NO: 113 | QSFDNNANPV |

TABLE 6-continued

Rabbit-Derived Antibody Amino Acid Sequences. CDR sequences are highlighted in bold underlined text.

| Antibody ID | Sequence |
|---|---|
| M0859 scFv SEQ ID NO: 114 | QSVKESGGRLVTPGTPLTLTCTVSGFSLSNYAMSWVRQAP GKGLEYIGIVSSGGTTYYASWAKGRFTISKTSTTVDLKITS PTTEDTATYFCAKDLYYGPTTYSAFNLWGQGTLVTISSG GGGSGGGGSGGGGSGGGGASELVLTQPQSVSGSLGQTVSI SCKRARDNIEDYYVHWYQQHPGKTPTIVIHKDDQRPSGV PDRFSGSIDSTSNSASLTITGLLAEDEADYFCQSFDNDASP VFGGGTQLTVTG |
| M0859 VH SEQ ID NO: 115 | QSVKESGGRLVTPGTPLTLTCTVSGFSLSNYAMSWVRQAP GKGLEYIGIVSSGGTTYYASWAKGRFTISKTSTTVDLKITS PTTEDTATYFCAKDLYYGPTTYSAFNLWGQGTLVTISS |
| M0859 VL SEQ ID NO: 116 | ELVLTQPQSVSGSLGQTVSISCKRARDNIEDYYVHWYQQ HPGKTPTIVIHKDDQRPSGVPDRFSGSIDSTSNSASLTITGL LAEDEADYFCQSFDNDASPVFGGGTQLTVTG |
| M0859 CDRH1 SEQ ID NO: 117 | SNYAMS |
| M0859 CDRH2 SEQ ID NO: 118 | IVSSGGTTYYASWAKG |
| M0859 CDRH3 SEQ ID NO: 119 | DLYYGPTTYSAFNL |
| M0859 CDRL1 SEQ ID NO: 120 | KRARDNIEDYYVH |
| M0859 CDRL2 SEQ ID NO: 121 | KDDQRPS |
| M0859 CDRL3 SEQ ID NO: 122 | QSFDNDASPV |
| M0860 scFv SEQ ID NO: 123 | QSVKESGGRLVTPGTPLTLTCTVSGFSLSNYAMSWVRQAP GKGLEYIGIVSSGGTTYYASWAKGRFTISKTSTTVDLKITS PTTEDTATYFCAKDLYYGPTTYSAFNLWGQGTLVTISSG GGGSGGGGSGGGGSGGGGASELVLTQPQSVSGSLGQTVSI SCKRARDNIEDYYVHWYQQYPGKTPTIVIYKDDQRPSGV PDRFSGSIDSTSNSASLTITGLLAEDEADYFCQSFDNNANV VFGGGTQLTVTG |
| M0860 VH SEQ ID NO: 124 | QSVKESGGRLVTPGTPLTLTCTVSGFSLSNYAMSWVRQAP GKGLEYIGIVSSGGTTYYASWAKGRFTISKTSTTVDLKITS PTTEDTATYFCAKDLYYGPTTYSAFNLWGQGTLVTISS |
| M0860 VL SEQ ID NO: 125 | ELVLTQPQSVSGSLGQTVSISCKRARDNIEDYYVHWYQQ YPGKTPTIVIYKDDQRPSGVPDRFSGSIDSTSNSASLTITGL LAEDEADYFCQSFDNNANVVFGGGTQLTVTG |
| M0860 CDRH1 SEQ ID NO: 126 | SNYAMS |
| M0860 CDRH2 SEQ ID NO: 127 | IVSSGGTTYYASWAKG |
| M0860 CDRH3 SEQ ID NO: 128 | DLYYGPTTYSAFNL |
| M0860 CDRL1 SEQ ID NO: 129 | KRARDNIEDYYVH |
| M0860 CDRL2 SEQ ID NO: 130 | KDDQRPS |
| M0860 CDRL3 SEQ ID NO: 131 | QSFDNNANVV |
| M0861 scFv SEQ ID NO: 132 | QSVKESGGRLVTPGTPLTLTCTVSGFSLSNYAMSWVRQAP GKGLEYIGIVSSGGTTYYASWAKGRFTISKTSTTVDLKITS PTTEDTATYFCAKDLYYGPTTYSAFNLWGQGTLVTISSG GGGSGGGGSGGGGSGGGGASELVLTQPASVQVNLGQTVS LTCTADTLSRSYASWYQLKPGQAPVLLIYRDTSRPSGVPD RFSGSSSGNTATLTISGAQAGDEGDYVCATSDGSGSNFQL FGGGTQLTVTG |

TABLE 6-continued

Rabbit-Derived Antibody Amino Acid Sequences. CDR sequences are highlighted in bold underlined text.

| Antibody ID | Sequence |
|---|---|
| M0861 VH SEQ ID NO: 133 | QSVKESGGRLVTPGTPLTLTCTVSGFSLSNYAMSWVRQAP GKGLEYIGIVSSGGTTYYASWAKGRFTISKTSTTVDLKITS PTTEDTATYFCAKDLYYGPTTYSAFNLWGQGTLVTISS |
| M0861 VL SEQ ID NO: 134 | ELVLTQPASVQVNLGQTVSLTCTADTLSRSYASWYQLKP GQAPVLLIYRDTSRPSGVPDRFSGSSSGNTATLTISGAQAG DEGDYVCATSDGSGSNFQLFGGGTQLTVTG |
| M0861 CDRH1 SEQ ID NO: 135 | SNYAMS |
| M0861 CDRH2 SEQ ID NO: 136 | IVSSGGTTYYASWAKG |
| M0861 CDRH3 SEQ ID NO: 137 | DLYYGPTTYSAFNL |
| M0861 CDRL1 SEQ ID NO: 138 | TADTLSRSYAS |
| M0861 CDRL2 SEQ ID NO: 139 | RDTSRPS |
| M0861 CDRL3 SEQ ID NO: 140 | ATSDGSGSNFQL |
| M0862 scFv SEQ ID NO: 141 | PEQLMESGGGLVTPGGVLTLTCTASGFSFSSYGVNWVRQ APGKGLEWIGFIFGDTTYYANWAKGRFTISKTSTTVDL KMTSPTTEDTATYFCARDGYGGYDYIINLWGQGTLVTVS SGGGGSGGGGSGGGGSGGGGASAQVLTQTPASVSAAVGG TVSISCQSSQSVVNNNWLAWYQQKPGQPPKLLIYKASTL ESGVPSRFKGSGSGTQFTLTISGVQADDAATYYCLGEFSC SSADCHAFGGGTELEIL |
| M0862 VH SEQ ID NO: 142 | PEQLMESGGGLVTPGGVLTLTCTASGFSFSSYGVNWVRQ APGKGLEWIGFIFGDTTYYANWAKGRFTISKTSTTVDL KMTSPTTEDTATYFCARDGYGGYDYIINLWGQGTLVTVS S |
| M0862 VL SEQ ID NO: 143 | AQVLTQTPASVSAAVGGTVSISCQSSQSVVNNNWLAWYQ QKPGQPPKLLIYKASTLESGVPSRFKGSGSGTQFTLTISGV QADDAATYYCLGEFSCSSADCHAFGGGTELEIL |
| M0862 CDRH1 SEQ ID NO: 144 | SYGVN |
| M0862 CDRH2 SEQ ID NO: 145 | FIFGDTTYYANWAKG |
| M0862 CDRH3 SEQ ID NO: 146 | DGYGGYDYIINL |
| M0862 CDRL1 SEQ ID NO: 147 | QSSQSVVNNN |
| M0862 CDRL2 SEQ ID NO: 148 | KASTLES |
| M0862 CDRL3 SEQ ID NO: 149 | LGEFSCSSADCHA |
| M0863 scFv SEQ ID NO: 150 | PEQLMESGGGLVTPGGVLTLTCTASGFSFSSYGVNWVRQ APGKGLEWIGFIFGDTTYYANWAKGRFTISKTSTTVDL KMTSPTTEDTATYFCARDGYGGYDYIINLWGQGTLVTVS SGGGGSGGGGSGGGGSGGGGASAQVLTQTPASVSAAVGG TVSISCQSSQSVVNNNWLAWYQQKPGQPPKLLIYKASTL ESGVPSRFKGSGSGTQFTLTISGVQADDAATYYCQGAYSG NIYYNAFGGGTEVVVK |
| M0863 VH SEQ ID NO: 151 | PEQLMESGGGLVTPGGVLTLTCTASGFSFSSYGVNWVRQ APGKGLEWIGFIFGDTTYYANWAKGRFTISKTSTTVDL KMTSPTTEDTATYFCARDGYGGYDYIINLWGQGTLVTVS S |

TABLE 6-continued

Rabbit-Derived Antibody Amino Acid Sequences. CDR sequences are highlighted in bold underlined text.

| Antibody ID | Sequence |
|---|---|
| M0863 VL<br>SEQ ID NO: 152 | AQVLTQTPASVSAAVGGTVSISCQSSQSVVNNNWLAWYQ<br>QKPGQPPKLLIYKASTLESGVPSRFKGSGSGTQFTLTISGV<br>QADDAATYYCQGAYSGNIYYNAFGGGTEVVVK |
| M0863 CDRH1<br>SEQ ID NO: 153 | SSYGVN |
| M0863 CDRH2<br>SEQ ID NO: 154 | FIFGDGTTYYANWAKG |
| M0863 CDRH3<br>SEQ ID NO: 155 | DGYGGYDYIINL |
| M0863 CDRL1<br>SEQ ID NO: 156 | QSSQSVVNNN |
| M0863 CDRL2<br>SEQ ID NO: 157 | KASTLES |
| M0863 CDRL3<br>SEQ ID NO: 158 | QGAYSGNIYYNA |
| M0864 scFv<br>SEQ ID NO: 159 | QSVKESGGGLVTPGTPLTLTCTVSGFSLSTYAISWVRQAP<br>GKGLEWIGFIDTVDSAYYASWAKGRFTISKTSSTTVDLK<br>MTSPTTEDTATYFCAKLRYGDYGDYTLWGQGTLVTVSS<br>GGGGSGGGGSGGGGSGGGGASELVMTQTPSPVSGAVGGT<br>VTIKCQASQNIYSYLAWYQQKPGQPPKLLIYKASTLASGV<br>PSRVKGSGSGTEYTLTISGVQAADAATYYCQCTYYDSNTF<br>GGGTEVVVK |
| M0864 VH<br>SEQ ID NO: 160 | QSVKESGGGLVTPGTPLTLTCTVSGFSLSTYAISWVRQAP<br>GKGLEWIGFIDTVDSAYYASWAKGRFTISKTSSTTVDLK<br>MTSPTTEDTATYFCAKLRYGDYGDYTLWGQGTLVTVSS |
| M0864 VL<br>SEQ ID NO: 161 | ELVMTQTPSPVSGAVGGTVTIKCQASQNIYSYLAWYQQK<br>PGQPPKLLIYKASTLASGVPSRVKGSGSGTEYTLTISGVQA<br>ADAATYYCQCTYYDSNTFGGGTEVVVK |
| M0864 CDRH1<br>SEQ ID NO: 162 | STYAIS |
| M0864 CDRH2<br>SEQ ID NO: 163 | FIDTVDSAYYASWAKG |
| M0864 CDRH3<br>SEQ ID NO: 164 | LRYGDYGDYTL |
| M0864 CDRL1<br>SEQ ID NO: 165 | QASQNIYSYLA |
| M0864 CDRL2<br>SEQ ID NO: 166 | KASTLAS |
| M0864 CDRL3<br>SEQ ID NO: 167 | QCTYYDSNT |
| M0865 scFv<br>SEQ ID NO: 168 | PAALMESGGRLVTPGTPLTLTCTVSGIDLSTFAMTWVRQA<br>PGKGLEWLGIINTGGSAYYTSWAKGRFTISRTSTTVDLKI<br>TSPTTEDTATYFCARGDWSSATDLWGQGTLVTISSGGGGS<br>GGGGSGGGGSGGGGASDPDMTQTPSSVSAAVGGTVTINC<br>QASQSVYDNKVLAWYRQKPGQPPKLLIYKASTLASGVPS<br>RFKGRGSGTQFTLTISGVQADDAATYYCLGEFSCSSADCH<br>AFGGGTELEIL |
| M0865 VH<br>SEQ ID NO: 169 | PAALMESGGRLVTPGTPLTLTCTVSGIDLSTFAMTWVRQA<br>PGKGLEWLGIINTGGSAYYTSWAKGRFTISRTSTTVDLKI<br>TSPTTEDTATYFCARGDWSSATDLWGQGTLVTISS |
| M0865 VL<br>SEQ ID NO: 170 | DPDMTQTPSSVSAAVGGTVTINCQASQSVYDNKVLAWY<br>RQKPGQPPKLLIYKASTLASGVPSRFKGRGSGTQFTLTISG<br>VQADDAATYYCLGEFSCSSADCHAFGGGTELEIL |
| M0865 CDRH1<br>SEQ ID NO: 171 | STFAMT |

TABLE 6-continued

Rabbit-Derived Antibody Amino Acid Sequences. CDR sequences are highlighted in bold underlined text.

| Antibody ID | Sequence |
|---|---|
| M0865 CDRH2<br>SEQ ID NO: 172 | IINTGGSAYYTSWAKG |
| M0865 CDRH3<br>SEQ ID NO: 173 | GDWSSATDL |
| M0865 CDRL1<br>SEQ ID NO: 174 | QASQSVYDNKVLA |
| M0865 CDRL2<br>SEQ ID NO: 175 | KASTLAS |
| M0865 CDRL3<br>SEQ ID NO: 176 | LGEFSCSSADCHA |
| M0866 scFv<br>SEQ ID NO: 177 | QSVKESGGRLVTPGTPLTLTCTASGFTISSSAISWVRQAPG KGLEYIGIIRSGGTTDYASWAKGRFAISKTSTTVDLKITSP TTEDTATYFCARDPPYITSTYFDLWGQGTLVTVSSGGGGS GGGGSGGGGSGGGGASELVLTQPQSVSGSLGQTVSISCKR ARDSVESYDVHWYQQHPGKTPTIVIYKDDQRPSGVPDRF SGSIDSTSNSASLTITGLLAEDEADYFCQSFDGDAVVFGGG TQLTVTG |
| M0866 VH<br>SEQ ID NO: 178 | QSVKESGGRLVTPGTPLTLTCTASGFTISSSAISWVRQAPG KGLEYIGIIRSGGTTDYASWAKGRFAISKTSTTVDLKITSP TTEDTATYFCARDPPYITSTYFDLWGQGTLVTVSS |
| M0866 VL<br>SEQ ID NO: 179 | ELVLTQPQSVSGSLGQTVSISCKRARDSVESYDVHWYQQ HPGKTPTIVIYKDDQRPSGVPDRFSGSIDSTSNSASLTITGL LAEDEADYFCQSFDGDAVVFGGGTQLTVTG |
| M0866 CDRH1<br>SEQ ID NO: 180 | SSSAIS |
| M0866 CDRH2<br>SEQ ID NO: 181 | IIRSGGTTDYASWAKG |
| M0866 CDRH3<br>SEQ ID NO: 182 | DPPYITSTYFDL |
| M0866 CDRL1<br>SEQ ID NO: 183 | KRARDSVESYDVH |
| M0866 CDRL2<br>SEQ ID NO: 184 | KDDQRPSG |
| M0866 CDRL3<br>SEQ ID NO: 185 | QSFDGDAVV |
| M0700 HC<br>SEQ ID NO: 265 | QEQLVESGGGLVTPGTPLTLTCTVSGFSLSSYAMGWVRQ APGKGLEWIGTINDGGTAFYASWVKGRFTISRTSTTVDLR VTSPTTEDTATYFCARAYGSNGDVYWGYFNLWGQGTLV TVSSASTKGPSVFPLAPSSKSTSGGTAALGCLVKDYFPEPV TVSWNSGALTSGVHTFPAVLQSSGLYSLSSVVTVPSSSLGT QTYICNVNHKPSNTKVDKKVEPKSC |
| M0700 LC<br>SEQ ID NO: 266 | ASELDLTQTPASVEVAVGGTVTIKCQASQSIGSYLSWYQQ KPGQRPKLLIFRASTLASGVSSRFKGSGSGTQFTLTISGVEC ADAATYYCQQGYSSTNLDNVFGGGTEVVVKRTVAAPSV FIFPPPSDEQLKSGTASVVCLLNNFYPREAKVQWKVDNALQ SGNSQESVTEQDSKDSTYSLSSTLTLSKADYEKHKVYACE VTHQGLSSPVTKSFNRGEC |
| M0700 VH<br>SEQ ID NO: 267 | QEQLVESGGGLVTPGTPLTLTCTVSGFSLSSYAMGWVRQ APGKGLEWIGTINDGGTAFYASWVKGRFTISRTSTTVDLR VTSPTTEDTATYFCARAYGSNGDVYWGYFNLWGQGTLV TVSS |
| M0700 VL<br>SEQ ID NO: 268 | ASELDLTQTPASVEVAVGGTVTIKCQASQSIGSYLSWYQQ KPGQRPKLLIFRASTLASGVSSRFKGSGSGTQFTLTISGVEC ADAATYYCQQGYSSTNLDNVFGGGTEVVVK |
| M0700 CDRH1<br>SEQ ID NO: 397 | SSYAMG |

TABLE 6-continued

Rabbit-Derived Antibody Amino Acid Sequences. CDR sequences are highlighted in bold underlined text.

| Antibody ID | Sequence |
|---|---|
| M0700 CDRH2 SEQ ID NO: 398 | TINDGGTAFYASWVKG |
| M0700 CDRH3 SEQ ID NO: 399 | AYGSNGDVYWGYFNL |
| M0700 CDRL1 SEQ ID NO: 400 | QASQSIGSYLS |
| M0700 CDRL2 SEQ ID NO: 401 | RASTLAS |
| M0700 CDRL3 SEQ ID NO: 402 | QQGYSSTNLDNV |
| M0701 HC SEQ ID NO: 269 | QEQLEESGGGLVTPGGTLTLTCTVSGFSLSNYAMGWVRQ APGKGLEWIGTINDGGTAFYAKWLKGRFTISRTSTTVDL KITSPTTEDTATYFCARAYGSNGDVYWGYFNLWGQGTL VTVSSASTKGPSVFPLAPSSKSTSGGTAALGCLVKDYFPEP VTVSWNSGALTSGVHTFPAVLQSSGLYSLSSVVTVPSSSLG TQTYICNVNHKPSNTKVDKKVEPKSC |
| M0701 LC SEQ ID NO: 270 | ASELVMTQTPSSVSEPVGGTVTIKCQASQSIGSNLAWYQQ RPGQPPKLLIYSASTLASGVSSRFKGSGSGTESTLTISGVQA ADAATYYCQQGYSSSNVDNVFGGGTELEILRTVAAPSVFI FPPSDEQLKSGTASVVCLLNNFYPREAKVQWKVDNALQS GNSQESVTEQDSKDSTYSLSSTLTLSKADYEKHKVYACEV THQGLSSPVTKSFNRGEC |
| M0701 VH SEQ ID NO: 271 | QEQLEESGGGLVTPGGTLTLTCTVSGFSLSNYAMGWVRQ APGKGLEWIGTINDGGTAFYAKWLKGRFTISRTSTTVDL KITSPTTEDTATYFCARAYGSNGDVYWGYFNLWGQGTL VTVSS |
| M0701 VL SEQ ID NO: 272 | ASELVMTQTPSSVSEPVGGTVTIKCQASQSIGSNLAWYQQ RPGQPPKLLIYSASTLASGVSSRFKGSGSGTESTLTISGVQA ADAATYYCQQGYSSSNVDNVFGGGTELEIL |
| M0701 CDRH1 SEQ ID NO: 403 | SNYAMG |
| M0701 CDRH2 SEQ ID NO: 404 | TINDGGTAFYAKWLKG |
| M0701 CDRH3 SEQ ID NO: 405 | AYGSNGDVYWGYFNL |
| M0701 CDRL1 SEQ ID NO: 406 | QASQSIGSNLA |
| M0701 CDRL2 SEQ ID NO: 407 | SASTLAS |
| M0701 CDRL3 SEQ ID NO: 408 | QQGYSSSNVDNV |
| M0702 HC SEQ ID NO: 273 | QEQLEESGGGLVTPGTPLTLTCTASGFSLSSYAMIWVRQA PGKGLEWIGTINDGGTAFYANWVKGRFTISRTSTTVDLK MTSPTTEDTATYFCARAYGSNGDVYWGYVNLWGQGTL VTVSSASTKGPSVFPLAPSSKSTSGGTAALGCLVKDYFPEP VTVSWNSGALTSGVHTFPAVLQSSGLYSLSSVVTVPSSSLG TQTYICNVNHKPSNTKVDKKVEPKSC |
| M0702 LC SEQ ID NO: 274 | ASELVMTQTPASVSEPVGGTVTIKCQASQSIGSNLAWYQQ KPGQPPKLLIYAAANLASGVSSRFKGSRSGTEYTLTISGVQ AADAATYYCQQGYSSSNVANVFGGGTELEILRTVAAPSV FIFPPSDEQLKSGTASVVCLLNNFYPREAKVQWKVDNALQ SGNSQESVTEQDSKDSTYSLSSTLTLSKADYEKHKVYACE VTHQGLSSPVTKSFNRGEC |
| M0702 VH SEQ ID NO: 275 | QEQLEESGGGLVTPGTPLTLTCTASGFSLSSYAMIWVRQA PGKGLEWIGTINDGGTAFYANWVKGRFTISRTSTTVDLK MTSPTTEDTATYFCARAYGSNGDVYWGYVNLWGQGTL VTVSS |

TABLE 6-continued

Rabbit-Derived Antibody Amino Acid Sequences. CDR sequences are highlighted in bold underlined text.

| Antibody ID | Sequence |
|---|---|
| M0702 VL<br>SEQ ID NO: 276 | ASELVMTQTPASVSEPVGGTVTIKCQASQSIGSNLAWYQQ<br>KPGQPPKLLIYAAANLASGVSSRFKGSRSGTEYTLTISGVQ<br>AADAATYYCQQGYSSSNVANVFGGGTELEIL |
| M0702 CDRH1<br>SEQ ID NO: 409 | SSYAMI |
| M0702 CDRH2<br>SEQ ID NO: 410 | TINDGGTAFYANWVKG |
| M0702 CDRH3<br>SEQ ID NO: 411 | AYGSNGDVYWGYVNL |
| M0702 CDRL1<br>SEQ ID NO: 412 | QASQSIGSNLA |
| M0702 CDRL2<br>SEQ ID NO: 413 | AAANLAS |
| M0702 CDRL3<br>SEQ ID NO: 414 | QQGYSSSNVANV |
| M0703 HC<br>SEQ ID NO: 277 | QEQLEESGGGLVTPGTPLTLTCTASGFSLSSYAMIWVRQA<br>PGKGLEWIGTINDGGTAFYASWVKGRFTISRTSTTVDLKI<br>TSPTTEDTATYFCARAYGSNGDVYWGYVNLWGQGTLVT<br>VSSASTKGPSVFPLAPSSKSTSGGTAALGCLVKDYFPEPVT<br>VSWNSGALTSGVHTFPAVLQSSGLYSLSSVVTVPSSSLGTQ<br>TYICNVNHKPSNTKVDKKVEPKSC |
| M0703 LC<br>SEQ ID NO: 278 | ASELVMTQTPSSVSAAVGGTVTINCQASQNIGSVFAWYQ<br>QKPGQPPKLLIYKASSLASGVPSRFKGSGSGTQFTLTISGV<br>EEADAATYYCQQGASSSNVDNIFGGGTEVVVKRTVAAPS<br>VFIFPPSDEQLKSGTASVVCLLNNFYPREAKVQWKVDNAL<br>QSGNSQESVTEQDSKDSTYSLSSTLTLSKADYEKHKVYAC<br>EVTHQGLSSPVTKSFNRGEC |
| M0703 VH<br>SEQ ID NO: 279 | QEQLEESGGGLVTPGTPLTLTCTASGFSLSSYAMIWVRQA<br>PGKGLEWIGTINDGGTAFYASWVKGRFTISRTSTTVDLKI<br>TSPTTEDTATYFCARAYGSNGDVYWGYVNLWGQGTLVT<br>VSS |
| M0703 VL<br>SEQ ID NO: 280 | ASELVMTQTPSSVSAAVGGTVTINCQASQNIGSVFAWYQ<br>QKPGQPPKLLIYKASSLASGVPSRFKGSGSGTQFTLTISGV<br>EEADAATYYCQQGASSSNVDNIFGGGTEVVVK |
| M0703 CDRH1<br>SEQ ID NO: 415 | SSYAMI |
| M0703 CDRH2<br>SEQ ID NO: 416 | TINDGGTAFYASWVKG |
| M0703 CDRH3<br>SEQ ID NO: 417 | AYGSNGDVYWGYVNL |
| M0703 CDRL1<br>SEQ ID NO: 418 | QASQNIGSVFA |
| M0703 CDRL2<br>SEQ ID NO: 419 | KASSLAS |
| M0703 CDRL3<br>SEQ ID NO: 420 | QQGASSSNVDNI |
| M0704 HC<br>SEQ ID NO: 281 | QQQLEESGGGLVTPGTPLTLTCTVSGIDLSSYAMGWVRQ<br>APGKGLEWIGTINDGGSAFYASWVKGRFTISRTSTTVDLK<br>ITSPTAEDTATYFCAKTYGTNGDVYWGYFNLWGQGTLV<br>TVSSASTKGPSVFPLAPSSKSTSGGTAALGCLVKDYFPEPV<br>TVSWNSGALTSGVHTFPAVLQSSGLYSLSSVVTVPSSSLGT<br>QTYICNVNHKPSNTKVDKKVEPKSC |

TABLE 6-continued

Rabbit-Derived Antibody Amino Acid Sequences. CDR sequences are highlighted in bold underlined text.

| Antibody ID | Sequence |
|---|---|
| M0704 LC<br>SEQ ID NO: 282 | ASELVMTQTPASVSEPVGGTVTIKCQASQSIGSNLAWYQQ<br>KPGQPPKLLIYYESILASGVPSRFSGSGSGTEYTLTISGAQA<br>DDAATYYCQQGYSSSNIDNAFGGGTEVVVKRTVAAPSVF<br>IFPPSDEQLKSGTASVVCLLNNFYPREAKVQWKVDNALQS<br>GNSQESVTEQDSKDSTYSLSSTLTLSKADYEKHKVYACEV<br>THQGLSSPVTKSFNRGEC |
| M0704 VH<br>SEQ ID NO: 283 | QQQLEESGGGLVTPGTPLTLTCTVSGIDLSSYAMGWVRQ<br>APGKGLEWIGTINDGGSAFYASWVKGRFTISRTSTTVDLK<br>ITSPTAEDTATYFCAKTYGTNGDVYWGYFNLWGQGTLV<br>TVSS |
| M0704 VL<br>SEQ ID NO: 284 | ASELVMTQTPASVSEPVGGTVTIKCQASQSIGSNLAWYQQ<br>KPGQPPKLLIYYESILASGVPSRFSGSGSGTEYTLTISGAQA<br>DDAATYYCQQGYSSSNIDNAFGGGTEVVVK |
| M0704 CDRH1<br>SEQ ID NO: 421 | SSYAMG |
| M0704 CDRH2<br>SEQ ID NO: 422 | TINDGGSAFYASWVKG |
| M0704 CDRH3<br>SEQ ID NO: 423 | TYGTNGDVYWGYFNL |
| M0704 CDRL1<br>SEQ ID NO: 424 | QASQSIGSNLA |
| M0704 CDRL2<br>SEQ ID NO: 425 | YESILAS |
| M0704 CDRL3<br>SEQ ID NO: 426 | QQGYSSSNIDNA |
| M0705 HC<br>SEQ ID NO: 285 | QQQLVESGGRLVTPGTPLTLTCTASGIDLNSNAMSWVRQ<br>GPGKGLEWIGDIWSGGYTDYASWAKGRFTISKTSTTVDL<br>KMTSLTAADTATYFCARDRLAGDGVVDYDLWGQGTLVT<br>VSSASTKGPSVFPLAPSSKSTSGGTAALGCLVKDYFPEPVT<br>VSWNSGALTSGVHTFPAVLQSSGLYSLSSVVTVPSSSLGTQ<br>TYICNVNHKPSNTKVDKKVEPKSC |
| M0705 LC<br>SEQ ID NO: 286 | ASELDMTQTPASVEVAVGGTVTIKCQASQNIYSNLAWYQ<br>QKPGQRPKLLIYGASTLASGVPSRFKGSGSGTEYTLTINGV<br>QAADAATYYCQQGFSSSNVDNVFGGGTEVVVKRTVAAP<br>SVFIFPPSDEQLKSGTASVVCLLNNFYPREAKVQWKVDNA<br>LQSGNSQESVTEQDSKDSTYSLSSTLTLSKADYEKHKVYA<br>CEVTHQGLSSPVTKSFNRGEC |
| M0705 VH<br>SEQ ID NO: 287 | QQQLVESGGRLVTPGTPLTLTCTASGIDLNSNAMSWVRQ<br>GPGKGLEWIGDIWSGGYTDYASWAKGRFTISKTSTTVDL<br>KMTSLTAADTATYFCARDRLAGDGVVDYDLWGQGTLVT<br>VSS |
| M0705 VL<br>SEQ ID NO: 288 | ASELDMTQTPASVEVAVGGTVTIKCQASQNIYSNLAWYQ<br>QKPGQRPKLLIYGASTLASGVPSRFKGSGSGTEYTLTINGV<br>QAADAATYYCQQGFSSSNVDNVFGGGTEVVVK |
| M0705 CDRH1<br>SEQ ID NO: 427 | NSNAMS |
| M0705 CDRH2<br>SEQ ID NO: 428 | DIWSGGYTDYASWAKG |
| M0705 CDRH3<br>SEQ ID NO: 429 | DRLAGDGVVDYDL |
| M0705 CDRL1<br>SEQ ID NO: 430 | QASQNIYSNLA |
| M0705 CDRL2<br>SEQ ID NO: 431 | GASTLAS |
| M0705 CDRL3<br>SEQ ID NO: 432 | QQGFSSSNVDNV |

TABLE 6-continued

Rabbit-Derived Antibody Amino Acid Sequences. CDR sequences are highlighted in bold underlined text.

| Antibody ID | Sequence |
|---|---|
| M0706 HC SEQ ID NO: 289 | QQQLEESGGGLVTPGTPLTLTCTVSGFSLSNYAMGWVRQ APGKGLEWIGTINDGGTAFYANWLKGRFTISRTSTTVDL KITSPTTEDTATYFCARAYGSNGDVYWGYFNLWGQGTL VTVSSASTKGPSVFPLAPSSKSTSGGTAALGCLVKDYFPEP VTVSWNSGALTSGVHTFPAVLQSSGLYSLSSVVTVPSSSLG TQTYICNVNHKPSNTKVDKKVEPKSC |
| M0706 LC SEQ ID NO: 290 | ASELVMTQTASPVSAAVGGTVTINCQASQSISSRSLSWYQ QKPGQPPKLLIYEASKLASGVPSRFSGSGSGTQFTLTISGV QADDAATYYCQQGYSSSNVDNVFGGGTEVVVKRTVAAP SVFIFPPSDEQLKSGTASVVCLLNNFYPREAKVQWKVDNA LQSGNSQESVTEQDSKDSTYSLSSTLTLSKADYEKHKVYA CEVTHQGLSSPVTKSFNRGEC |
| M0706 VH SEQ ID NO: 291 | QQQLEESGGGLVTPGTPLTLTCTVSGFSLSNYAMGWVRQ APGKGLEWIGTINDGGTAFYANWLKGRFTISRTSTTVDL KITSPTTEDTATYFCARAYGSNGDVYWGYFNLWGQGTL VTVSS |
| M0706 VL SEQ ID NO: 292 | ASELVMTQTASPVSAAVGGTVTINCQASQSISSRSLSWYQ QKPGQPPKLLIYEASKLASGVPSRFSGSGSGTQFTLTISGV QADDAATYYCQQGYSSSNVDNVFGGGTEVVVK |
| M0706 CDRH1 SEQ ID NO: 433 | SNYAMG |
| M0706 CDRH2 SEQ ID NO: 434 | TINDGGTAFYANWLKG |
| M0706 CDRH3 SEQ ID NO: 435 | AYGSNGDVYWGYFNL |
| M0706 CDRL1 SEQ ID NO: 436 | QASQSISSRSLS |
| M0706 CDRL2 SEQ ID NO: 437 | EASKLAS |
| M0706 CDRL3 SEQ ID NO: 438 | QQGYSSSNVDNV |
| M0707 HC SEQ ID NO: 293 | QQQLEESGGGLVTPGTPLTLTCTVSGIDLSSYAMGWVRQ APGKGLEWIGTINDGGSAFYASWVKGRFTISRTSTTVDLK ITSPTAEDTATYFCAKTYGTNGDVYWGYFNLWGQGTLV TVSSASTKGPSVFPLAPSSKSTSGGTAALGCLVKDYFPEPV TVSWNSGALTSGVHTFPAVLQSSGLYSLSSVVTVPSSSLGT QTYICNVNHKPSNTKVDKKVEPKSC |
| M0707 LC SEQ ID NO: 294 | ASELVMTQTPASVSEPVGGTVTIKCQASQSIGSNLAWYQQ KPGQPPKLLIYYESILASGVPSRFSGSGSGTEYTLTISGAQA DDAATYYCQQGYSSSNILNAFGGGTEVVVKRTVAAPSVF IFPPSDEQLKSGTASVVCLLNNFYPREAKVQWKVDNALQS GNSQESVTEQDSKDSTYSLSSTLTLSKADYEKHKVYACEV THQGLSSPVTKSFNRGEC |
| M0707 VH SEQ ID NO: 295 | QQQLEESGGGLVTPGTPLTLTCTVSGIDLSSYAMGWVRQ APGKGLEWIGTINDGGSAFYASWVKGRFTISRTSTTVDLK ITSPTAEDTATYFCAKTYGTNGDVYWGYFNLWGQGTLV TVSS |
| M0707 VL SEQ ID NO: 296 | ASELVMTQTPASVSEPVGGTVTIKCQASQSIGSNLAWYQQ KPGQPPKLLIYYESILASGVPSRFSGSGSGTEYTLTISGAQA DDAATYYCQQGYSSSNILNAFGGGTEVVVK |
| M0707 CDRH1 SEQ ID NO: 439 | SSYAMG |
| M0707 CDRH2 SEQ ID NO: 440 | TINDGGSAFYASWVKG |
| M0707 CDRH3 SEQ ID NO: 441 | TYGTNGDVYWGYFNL |
| M0707 CDRL1 SEQ ID NO: 442 | QASQSIGSNLA |

TABLE 6-continued

Rabbit-Derived Antibody Amino Acid Sequences. CDR sequences are highlighted in bold underlined text.

| Antibody ID | Sequence |
| --- | --- |
| M0707 CDRL2<br>SEQ ID NO: 443 | YESILAS |
| M0707 CDRL3<br>SEQ ID NO: 444 | QQGYSSSNILNA |
| M0708 HC<br>SEQ ID NO: 297 | QSVEESGGRLVTPGTPLTLTCTVSGFSLSNYAMSWVRQAP<br>GKGLEYIGIVSSGGTTYYASWAKGRFTISKTSTTVDLKITS<br>PTTEDTATYFCAKDLYYGPTTYSAFNLWGQGTLVTVSSA<br>STKGPSVFPLAPSSKSTSGGTAALGCLVKDYFPEPVTVSW<br>NSGALTSGVHTFPAVLQSSGLYSLSSVVTVPSSSLGTQTYI<br>CNVNHKPSNTKVDKKVEPKSC |
| M0708 LC<br>SEQ ID NO: 298 | ASELVLTQPQSVSGSLGQTVSISCKRARNNIEDYYVHWY<br>QQHPGRSPTIVIHKDDQRPSGVPDRFSGSIDSTSNSASLTIT<br>GLLAEDEADYFCQSFDNNANPVFGGGTQLTVTGRTVAAP<br>SVFIFPPSDEQLKSGTASVVCLLNNFYPREAKVQWKVDNA<br>LQSGNSQESVTEQDSKDSTYSLSSTLTLSKADYEKHKVYA<br>CEVTHQGLSSPVTKSFNRGEC |
| M0708 VH<br>SEQ ID NO: 299 | QSVEESGGRLVTPGTPLTLTCTVSGFSLSNYAMSWVRQAP<br>GKGLEYIGIVSSGGTTYYASWAKGRFTISKTSTTVDLKITS<br>PTTEDTATYFCAKDLYYGPTTYSAFNLWGQGTLVTVSS |
| M0708 VL<br>SEQ ID NO: 300 | ASELVLTQPQSVSGSLGQTVSISCKRARNNIEDYYVHWY<br>QQHPGRSPTIVIHKDDQRPSGVPDRFSGSIDSTSNSASLTIT<br>GLLAEDEADYFCQSFDNNANPVFGGGTQLTVTG |
| M0708 CDRH1<br>SEQ ID NO: 445 | SNYAMS |
| M0708 CDRH2<br>SEQ ID NO: 446 | IVSSGGTTYYASWAKG |
| M0708 CDRH3<br>SEQ ID NO: 447 | DLYYGPTTYSAFNL |
| M0708 CDRL1<br>SEQ ID NO: 448 | KRARNNIEDYYVH |
| M0708 CDRL2<br>SEQ ID NO: 449 | KDDQRPS |
| M0708 CDRL3<br>SEQ ID NO: 450 | QSFDNNANPV |
| M0709 HC<br>SEQ ID NO: 301 | QSVKESGGRLVTPGTPLTLTCTVSGFSLSNYAMSWVRQAP<br>GKGLEYIGIVSSGGTTYYASWAKGRFTISKTSTTVDLKITS<br>PTTEDTATYFCAKDLYYGPTTYSAFNLWGQGTLVTVSSA<br>STKGPSVFPLAPSSKSTSGGTAALGCLVKDYFPEPVTVSW<br>NSGALTSGVHTFPAVLQSSGLYSLSSVVTVPSSSLGTQTYI<br>CNVNHKPSNTKVDKKVEPKSC |
| M0709 LC<br>SEQ ID NO: 302 | ASELVLTQPQSVSGSLGQTVSISCKRARDNIEDYYVHWY<br>QQHPGKTPTIVIHKDDQRPSGVPDRFSGSIDSTSNSASLTIT<br>GLLAEDEADYFCQSFDNDASPVFGGGTQLTVTGRTVAAP<br>SVFIFPPSDEQLKSGTASVVCLLNNFYPREAKVQWKVDNA<br>LQSGNSQESVTEQDSKDSTYSLSSTLTLSKADYEKHKVYA<br>CEVTHQGLSSPVTKSFNRGEC |
| M0709 VH<br>SEQ ID NO: 303 | QSVKESGGRLVTPGTPLTLTCTVSGFSLSNYAMSWVRQAP<br>GKGLEYIGIVSSGGTTYYASWAKGRFTISKTSTTVDLKITS<br>PTTEDTATYFCAKDLYYGPTTYSAFNLWGQGTLVTVSS |
| M0709 VL<br>SEQ ID NO: 304 | ASELVLTQPQSVSGSLGQTVSISCKRARDNIEDYYVHWY<br>QQHPGKTPTIVIHKDDQRPSGVPDRFSGSIDSTSNSASLTIT<br>GLLAEDEADYFCQSFDNDASPVFGGGTQLTVTG |
| M0709 CDRH1<br>SEQ ID NO: 451 | SNYAMS |
| M0709 CDRH2<br>SEQ ID NO: 452 | IVSSGGTTYYASWAKG |

TABLE 6-continued

Rabbit-Derived Antibody Amino Acid Sequences. CDR sequences are highlighted in bold underlined text.

| Antibody ID | Sequence |
|---|---|
| M0709 CDRH3 SEQ ID NO: 453 | DLYYGPTTYSAFNL |
| M0709 CDRL1 SEQ ID NO: 454 | KRARDNIEDYYVH |
| M0709 CDRL2 SEQ ID NO: 455 | KDDQRPS |
| M0709 CDRL3 SEQ ID NO: 456 | QSFDNDASPV |
| M0710 HC SEQ ID NO: 305 | QSVKESGGRLVTPGTPLTLTCTVSGFSLSNYAMSWVRQAP GKGLEYIGIVSSGGTTYYASWAKGRFTISKTSTTVDLKITS PTTEDTATYFCAKDLYYGPTTYSAFNLWGQGTLVTVSSA STKGPSVFPLAPSSKSTSGGTAALGCLVKDYFPEPVTVSW NSGALTSGVHTFPAVLQSSGLYSLSSVVTVPSSSLGTQTYI CNVNHKPSNTKVDKKVEPKSC |
| M0710 LC SEQ ID NO: 306 | ASELVLTQPQSVSGSLGQTVSISCKRARDNIEDYYVHWY QQYPGKTPTIVIYKDDQRPSGVPDRFSGSIDSTSNSASLTIT GLLAEDEADYFCQSFDNNANVVFGGGTQLTVTGRTVAAP SVFIFPPSDEQLKSGTASVVCLLNNFYPREAKVQWKVDNA LQSGNSQESVTEQDSKDSTYSLSSTLTLSKADYEKHKVYA CEVTHQGLSSPVTKSFNRGEC |
| M0710 VH SEQ ID NO: 307 | QSVKESGGRLVTPGTPLTLTCTVSGFSLSNYAMSWVRQAP GKGLEYIGIVSSGGTTYYASWAKGRFTISKTSTTVDLKITS PTTEDTATYFCAKDLYYGPTTYSAFNLWGQGTLVTVSS |
| M0710 VL SEQ ID NO: 308 | ASELVLTQPQSVSGSLGQTVSISCKRARDNIEDYYVHWY QQYPGKTPTIVIYKDDQRPSGVPDRFSGSIDSTSNSASLTIT GLLAEDEADYFCQSFDNNANVVFGGGTQLTVTG |
| M0710CDRH1 SEQ ID NO: 457 | SNYAMS |
| M0710CDRH2 SEQ ID NO: 458 | IVSSGGTTYYASWAKG |
| M0710CDRH3 SEQ ID NO: 459 | DLYYGPTTYSAFNL |
| M0710CDRL1 SEQ ID NO: 460 | KRARDNIEDYYVH |
| M0710CDRL2 SEQ ID NO: 461 | KDDQRPS |
| M0710CDRL3 SEQ ID NO: 462 | QSFDNNANVV |
| M0762 HC SEQ ID NO: 309 | QSVKESGGRLVTPGTPLTLTCTASGFTISSSAISWVRQAPG KGLEYIGIIRSGGTTDYASWAKGRFAISKTSTTVDLKITSP TTEDTATYFCARDPPYITSTYFDLWGQGTLVTVSSASTKG PSVFPLAPSSKSTSGGTAALGCLVKDYFPEPVTVSWNSGA LTSGVHTFPAVLQSSGLYSLSSVVTVPSSSLGTQTYICNVN HKPSNTKVDKKVEPKSC |
| M0762 LC SEQ ID NO: 310 | ASELVLTQPQSVSGSLGQTVSISCKRARDSVESYDVHWY QQHPGKTPTIVIYKDDQRPSGVPDRFSGSIDSTSNSASLTIT GLLAEDEADYFCQSFDGDAVVFGGGTQLTVTGRTVAAPS VFIFPPSDEQLKSGTASVVCLLNNFYPREAKVQWKVDNAL QSGNSQESVTEQDSKDSTYSLSSTLTLSKADYEKHKVYAC EVTHQGLSSPVTKSFNRGEC |
| M0762 VH SEQ ID NO: 311 | QSVKESGGRLVTPGTPLTLTCTASGFTISSSAISWVRQAPG KGLEYIGIIRSGGTTDYASWAKGRFAISKTSTTVDLKITSP TTEDTATYFCARDPPYITSTYFDLWGQGTLVTVSS |
| M0762 VL SEQ ID NO: 312 | ASELVLTQPQSVSGSLGQTVSISCKRARDSVESYDVHWY QQHPGKTPTIVIYKDDQRPSGVPDRFSGSIDSTSNSASLTIT GLLAEDEADYFCQSFDGDAVVFGGGTQLTVTG |

TABLE 6-continued

Rabbit-Derived Antibody Amino Acid Sequences. CDR sequences are highlighted in bold underlined text.

| Antibody ID | Sequence |
|---|---|
| M0762 CDRH1 SEQ ID NO: 463 | SSSAIS |
| M0762 CDRH2 SEQ ID NO: 464 | IIRSGGTTDYASWAKG |
| M0762 CDRH3 SEQ ID NO: 465 | DPPYITSTYFDL |
| M0762 CDRL1 SEQ ID NO: 466 | KRARDSVESYDVH |
| M0762 CDRL2 SEQ ID NO: 467 | KDDQRPS |
| M0762 CDRL3 SEQ ID NO: 468 | QSFDGDAVV |
| M0763 HC SEQ ID NO: 313 | QSVKESGGRLVTPGTPLTLTCTVSGFSLSNYAMSWVRQAP GKGLEYIGIVSSGGTTYYASWAKGRFTISKTSTTVDLKITS PTTEDTATYFCAKDLYYGPTTYSAFNLWGQGTLVTVSSA STKGPSVFPLAPSSKSTSGGTAALGCLVKDYFPEPVTVSW NSGALTSGVHTFPAVLQSSGLYSLSSVVTVPSSSLGTQTYI CNVNHKPSNTKVDKKVEPKSC |
| M0763 LC SEQ ID NO: 314 | ASELVLTQPASVQVNLGQTVSLTCTADTLSRSYASWYQL KPGQAPVLLIYRDTSRPSGVPDRFSGSSSGNTATLTISGAQ AGDEGDYVCATSDGSGSNFQLFGGGTQLTVTGRTVAAPS VFIFPPSDEQLKSGTASVVCLLNNFYPREAKVQWKVDNAL QSGNSQESVTEQDSKDSTYSLSSTLTLSKADYEKHKVYAC EVTHQGLSSPVTKSFNRGEC |
| M0763 VH SEQ ID NO: 315 | QSVKESGGRLVTPGTPLTLTCTVSGFSLSNYAMSWVRQAP GKGLEYIGIVSSGGTTYYASWAKGRFTISKTSTTVDLKITS PTTEDTATYFCAKDLYYGPTTYSAFNLWGQGTLVTVSS |
| M0763 VL SEQ ID NO: 316 | ASELVLTQPASVQVNLGQTVSLTCTADTLSRSYASWYQL KPGQAPVLLIYRDTSRPSGVPDRFSGSSSGNTATLTISGAQ AGDEGDYVCATSDGSGSNFQLFGGGTQLTVTG |
| M0763 CDRH1 SEQ ID NO: 469 | SNYAMS |
| M0763 CDRH2 SEQ ID NO: 470 | IVSSGGTTYYASWAKG |
| M0763 CDRH3 SEQ ID NO: 471 | DLYYGPTTYSAFNL |
| M0763 CDRL1 SEQ ID NO: 472 | TADTLSRSYAS |
| M0763 CDRL2 SEQ ID NO: 473 | RDTSRPS |
| M0763 CDRL3 SEQ ID NO: 474 | ATSDGSGSNFQL |
| M0764 HC SEQ ID NO: 317 | QQQLEESGGGLVTPGTPLTLTCTVSGFSLSNYAMGWVRQ APGKGLEWIGTINDGGTAFYANWLKGRFTISRTSTTVDL KITSPTTEDTATYFCARAYGSNGDVYWGYFNLWGQGTL VTVSSASTKGPSVFPLAPSSKSTSGGTAALGCLVKDYFPEP VTVSWNSGALTSGVHTFPAVLQSSGLYSLSSVVTVPSSSLG TQTYICNVNHKPSNTKVDKKVEPKSC |
| M0764 LC SEQ ID NO: 318 | ASELVMTQTASPVSAAVGGTVTINCQASQSISSRSLSWYQ QKPGQPPKLLIYEASKLASGVPSRFSGSGSGTQFTLTISGV QADDAATYYCQQGYSSSNVDNFGGGTEVVVKRTVAAPS VFIFPPSDEQLKSGTASVVCLLNNFYPREAKVQWKVDNAL QSGNSQESVTEQDSKDSTYSLSSTLTLSKADYEKHKVYAC EVTHQGLSSPVTKSFNRGEC |

TABLE 6-continued

Rabbit-Derived Antibody Amino Acid Sequences. CDR sequences are highlighted in bold underlined text.

| Antibody ID | Sequence |
|---|---|
| M0764 VH<br>SEQ ID NO: 319 | QQQLEESGGGLVTPGTPLTLTCTVSGFSLSNYAMGWVRQ<br>APGKGLEWIGTINDGGTAFYANWLKGRFTISRTSTTVDL<br>KITSPTTEDTATYFCARAYGSNGDVYWGYFNLWGQGTL<br>VTVSS |
| M0764 VL<br>SEQ ID NO: 320 | ASELVMTQTASPVSAAVGGTVTINCQASQSISSRSLSWYQ<br>QKPGQPPKLLIYEASKLASGVPSRFSGSGSGTQFTLTISGV<br>QADDAATYYCQQGYSSSNVDNFGGGTEVVVK |
| M0764 CDRH1<br>SEQ ID NO: 475 | SNYAMG |
| M0764 CDRH2<br>SEQ ID NO: 476 | TINDGGTAFYANWLKG |
| M0764 CDRH3<br>SEQ ID NO: 477 | AYGSNGDVYWGYFNL |
| M0764 CDRL1<br>SEQ ID NO: 478 | QASQSISSRSLS |
| M0764 CDRL2<br>SEQ ID NO: 479 | EASKLAS |
| M0764 CDRL3<br>SEQ ID NO: 480 | QQGYSSSNVDN |
| M0765 HC<br>SEQ ID NO: 321 | QSVKESWGRLVTPGGSLTLTCTVSGIDLNNYAMGWVRQA<br>PGKGLEWIGTINNDGATYYPSWARGRFTISKTSTTVDLKI<br>TSPTTEDTATYFCARTYGSNGDVYWGYFNLWGQGTLVT<br>VSSASTKGPSVFPLAPSSKSTSGGTAALGCLVKDYFPEPVT<br>VSWNSGALTSGVHTFPAVLQSSGLYSLSSVVTVPSSSLGTQ<br>TYICNVNHKPSNTKVDKKVEPKSC |
| M0765 LC<br>SEQ ID NO: 322 | ASALELTQTPASVEVAVGGTVTINCQASQSIGGALNWYQ<br>QKSGQPPKLLIYLASTLASGVSSRFKGSGSGTQFTLTISGV<br>EAADAATYYCQQGYSASNIDNAFGGGTEVVVKRTVAAPS<br>VFIFPPSDEQLKSGTASVVCLLNNFYPREAKVQWKVDNAL<br>QSGNSQESVTEQDSKDSTYSLSSTLTLSKADYEKHKVYAC<br>EVTHQGLSSPVTKSFNRGEC |
| M0765 VH<br>SEQ ID NO: 323 | QSVKESWGRLVTPGGSLTLTCTVSGIDLNNYAMGWVRQA<br>PGKGLEWIGTINNDGATYYPSWARGRFTISKTSTTVDLKI<br>TSPTTEDTATYFCARTYGSNGDVYWGYFNLWGQGTLVT<br>VSS |
| M0765 VL<br>SEQ ID NO: 324 | ASALELTQTPASVEVAVGGTVTINCQASQSIGGALNWYQ<br>QKSGQPPKLLIYLASTLASGVSSRFKGSGSGTQFTLTISGV<br>EAADAATYYCQQGYSASNIDNAFGGGTEVVVK |
| M0765 CDRH1<br>SEQ ID NO: 481 | NNYAMG |
| M0765 CDRH2<br>SEQ ID NO: 482 | TINNDGATYYPSWA |
| M0765 CDRH3<br>SEQ ID NO: 483 | TYGSNGDVYWGYFNL |
| M0765 CDRL1<br>SEQ ID NO: 484 | QASQSIGGALN |
| M0765 CDRL2<br>SEQ ID NO: 485 | LASTLAS |
| M0765 CDRL3<br>SEQ ID NO: 486 | QQGYSASNIDNA |
| M0766 HC<br>SEQ ID NO: 325 | PEQLEESGGGLVTPGGVLTLTCTASGFSFSSYGVNWVRQA<br>PGKGLEWIGFIFGDTTYYANWAKGRFTISKTSTTVDLK<br>MTSPTTEDTATYFCARDGYGGYDYIINLWGQGTLVTVSS<br>ASTKGPSVFPLAPSSKSTSGGTAALGCLVKDYFPEPVTVS<br>WNSGALTSGVHTFPAVLQSSGLYSLSSVVTVPSSSLGTQT<br>YICNVNHKPSNTKVDKKVEPKSC |

TABLE 6-continued

Rabbit-Derived Antibody Amino Acid Sequences. CDR sequences are highlighted in bold underlined text.

| Antibody ID | Sequence |
|---|---|
| M0766 LC SEQ ID NO: 326 | ASAQVLTQTPASVSAAVGGTVSISCQSSQSVVNNNWLAW YQQKPGQPPKLLIYKASTLESGVPSRFKGSGSGTQFTLTIS GVQADDAATYYCLGEFSCSSADCHAFGGGTELEILRTVA APSVFIFPPSDEQLKSGTASVVCLLNNFYPREAKVQWKVD NALQSGNSQESVTEQDSKDSTYSLSSTLTLSKADYEKHKV YACEVTHQGLSSPVTKSFNRGEC |
| M0766 VH SEQ ID NO: 327 | PEQLEESGGGLVTPGGVLTLTCTASGFSFSSYGVNWVRQA PGKGLEWIGFIFGDGTTYYANWAKGRFTISKTSTTVDLK MTSPTTEDTATYFCARDGYGGYDYIINLWGQGTLVTVSS |
| M0766 VL SEQ ID NO: 328 | ASAQVLTQTPASVSAAVGGTVSISCQSSQSVVNNNWLAW YQQKPGQPPKLLIYKASTLESGVPSRFKGSGSGTQFTLTIS GVQADDAATYYCLGEFSCSSADCHAFGGGTELEIL |
| M0766 CDRH1 SEQ ID NO: 487 | SSYGVN |
| M0766 CDRH2 SEQ ID NO: 488 | FIFGDGTTYYANWAKG |
| M0766 CDRH3 SEQ ID NO: 489 | DGYGGYDYIINL |
| M0766 CDRL1 SEQ ID NO: 490 | QSSQSVVNNN |
| M0766 CDRL2 SEQ ID NO: 491 | KASTLES |
| M0766 CDRL3 SEQ ID NO: 492 | LGEFSCSSADCHA |
| M0767 HC SEQ ID NO: 329 | PEQLEESGGGLVTPGGVLTLTCTASGFSFSSYGVNWVRQA PGKGLEWIGFIFGDGTTYYANWAKGRFTISKTSTTVDLK MTSPTTEDTATYFCARDGYGGYDYIINLWGQGTLVTVSS ASTKGPSVFPLAPSSKSTSGGTAALGCLVKDYFPEPVTVS WNSGALTSGVHTFPAVLQSSGLYSLSSVVTVPSSSLGTQT YICNVNHKPSNTKVDKKVEPKSC |
| M0767 LC SEQ ID NO: 330 | ASAQVLTQTPASVSAAVGGTVSISCQSSQSVVNNNWLAW YQQKPGQPPKLLIYKASTLESGVPSRFKGSGSGTQFTLTIS GVQADDAATYYCQGAYSGNIYYNAFGGGTEVVVKRTVA APSVFIFPPSDEQLKSGTASVVCLLNNFYPREAKVQWKVD NALQSGNSQESVTEQDSKDSTYSLSSTLTLSKADYEKHKV YACEVTHQGLSSPVTKSFNRGEC |
| M0767 VH SEQ ID NO: 331 | PEQLEESGGGLVTPGGVLTLTCTASGFSFSSYGVNWVRQA PGKGLEWIGFIFGDGTTYYANWAKGRFTISKTSTTVDLK MTSPTTEDTATYFCARDGYGGYDYIINLWGQGTLVTVSS |
| M0767 VL SEQ ID NO: 332 | ASAQVLTQTPASVSAAVGGTVSISCQSSQSVVNNNWLAW YQQKPGQPPKLLIYKASTLESGVPSRFKGSGSGTQFTLTIS GVQADDAATYYCQGAYSGNIYYNAFGGGTEVVVK |
| M0767 CDRH1 SEQ ID NO: 493 | SSYGVN |
| M0767 CDRH2 SEQ ID NO: 494 | FIFGDGTTYYANWAKG |
| M0767 CDRH3 SEQ ID NO: 495 | DGYGGYDYIINL |
| M0767 CDRL1 SEQ ID NO: 496 | QSSQSVVNNN |
| M0767 CDRL2 SEQ ID NO: 497 | KASTLES |
| M0767 CDRL3 SEQ ID NO: 498 | QGAYSGNIYYNA |

TABLE 6-continued

Rabbit-Derived Antibody Amino Acid Sequences. CDR sequences are highlighted in bold underlined text.

| Antibody ID | Sequence |
|---|---|
| M0768 HC SEQ ID NO: 333 | QSVKESGGGLVTPGTPLTLTCTVSGFSLSTYAISWVRQAP GKGLEWIGFIDTVDSAYYASWAKGRFTISKTSSTTVDLK MTSPTTEDTATYFCAKLRYGDYGDYTLWGQGTLVTVSS ASTKGPSVFPLAPSSKSTSGGTAALGCLVKDYFPEPVTVS WNSGALTSGVHTFPAVLQSSGLYSLSSVVTVPSSSLGTQT YICNVNHKPSNTKVDKKVEPKSC |
| M0768 LC SEQ ID NO: 334 | ASELVMTQTPSPVSGAVGGTVTIKCQASQNIYSYLAWYQ QKPGQPPKLLIYKASTLASGVPSRVKGSGSGTEYTLTISGV QAADAATYYCQCTYYDSNTFGGGTEVVVKRTVAAPSVFI FPPSDEQLKSGTASVVCLLNNFYPREAKVQWKVDNALQS GNSQESVTEQDSKDSTYSLSSTLTLSKADYEKHKVYACEV THQGLSSPVTKSFNRGEC |
| M0768 VH SEQ ID NO: 335 | QSVKESGGGLVTPGTPLTLTCTVSGFSLSTYAISWVRQAP GKGLEWIGFIDTVDSAYYASWAKGRFTISKTSSTTVDLK MTSPTTEDTATYFCAKLRYGDYGDYTLWGQGTLVTVSS |
| M0768 VL SEQ ID NO: 336 | ASELVMTQTPSPVSGAVGGTVTIKCQASQNIYSYLAWYQ QKPGQPPKLLIYKASTLASGVPSRVKGSGSGTEYTLTISGV QAADAATYYCQCTYYDSNTFGGGTEVVVK |
| M0768 CDRH1 SEQ ID NO: 499 | STYAIS |
| M0768 CDRH2 SEQ ID NO: 500 | FIDTVDSAYYASWAKG |
| M0768 CDRH3 SEQ ID NO: 501 | LRYGDYGDYTL |
| M0768 CDRL1 SEQ ID NO: 502 | QASQNIYSYLA |
| M0768 CDRL2 SEQ ID NO: 503 | KASTLAS |
| M0768 CDRL3 SEQ ID NO: 504 | QCTYYDSNT |
| M0769 HC SEQ ID NO: 337 | PAALEESGGRLVTPGTPLTLTCTVSGIDLSTFAMTWVRQA PGKGLEWLGIINTGGSAYYTSWAKGRFTISRTSTTVDLKI TSPTTEDTATYFCARGDWSSATDLWGQGTLVTVSSASTK GPSVFPLAPSSKSTSGGTAALGCLVKDYFPEPVTVSWNSG ALTSGVHTFPAVLQSSGLYSLSSVVTVPSSSLGTQTYICNV NHKPSNTKVDKKVEPKSC |
| M0769 LC SEQ ID NO: 338 | ASDPDMTQTPSSVSAAVGGTVTINCQASQSVYDNKVLAW YRQKPGQPPKLLIYKASTLASGVPSRFKGRGSGTQFTLTIS GVQADDAATYYCLGEFSCSSADCHAFGGGTELEILRTVA APSVFIFPPSDEQLKSGTASVVCLLNNFYPREAKVQWKVD NALQSGNSQESVTEQDSKDSTYSLSSTLTLSKADYEKHKV YACEVTHQGLSSPVTKSFNRGEC |
| M0769 VH SEQ ID NO: 339 | PAALEESGGRLVTPGTPLTLTCTVSGIDLSTFAMTWVRQA PGKGLEWLGIINTGGSAYYTSWAKGRFTISRTSTTVDLKI TSPTTEDTATYFCARGDWSSATDLWGQGTLVTVSS |
| M0769 VL SEQ ID NO: 340 | ASDPDMTQTPSSVSAAVGGTVTINCQASQSVYDNKVLAW YRQKPGQPPKLLIYKASTLASGVPSRFKGRGSGTQFTLTIS GVQADDAATYYCLGEFSCSSADCHAFGGGTELEIL |
| M0769 CDRH1 SEQ ID NO: 505 | STFAMT |
| M0769 CDRH2 SEQ ID NO: 506 | IINTGGSAYYTSWAKG |
| M0769 CDRH3 SEQ ID NO: 507 | GDWSSATDL |

TABLE 6-continued

Rabbit-Derived Antibody Amino Acid Sequences. CDR sequences are highlighted in bold underlined text.

| Antibody ID | Sequence |
| --- | --- |
| M0769 CDRL1<br>SEQ ID NO: 508 | QASQSVYDNKVLA |
| M0769 CDRL2<br>SEQ ID NO: 509 | KASTLAS |
| M0769 CDRL3<br>SEQ ID NO: 510 | LGEFSCSSADCHA |
| CDR4-bispecific<br>01 (M0719HC)<br>SEQ ID NO: 341 | QSVEESGGRLVTPGTPLTLTCTVSGFSLSNYAMSWVRQAP<br>GKGLEYIGIVSSGGTTYYASWAKGRFTISKTSTTVDLKITS<br>PTTEDTATYFCAKDLYYGPTTYSAFNLWGQGTLVTVSSA<br>STKGPSVFPLAPSSKSTSGGTAALGCLVKDYFPEPVTVSW<br>NSGALTSGVHTFPAVLQSSGLYSLSSVVTVPSSSLGTQTYI<br>CNVNHKPSNTKVDKKVEPKSC |
| CDR4-bispecific<br>01 (M0719LC)<br>SEQ ID NO: 342 | ASELVLTQPQSVSGSLGQTVSISCKRARNNIEDYYVHWY<br>QQHPGRSPTIVIHKDDQRPSGVPDRFSGSIDSTSNSASLTIT<br>GLLAEDEADYFCQSFDNNANPVFGGGTQLTVTGRTVAAP<br>SVFIFPPSDEQLKSGTASVVCLLNNFYPREAKVQWKVDNA<br>LQSGNSQESVTEQDSKDSTYSLSSTLTLSKADYEKHKVYA<br>CEVTHQGLSSPVTKSFNRGECGGGGSAVVTQEPSLTVSPG<br>GTVTLTCGSSTGAVTTSNYANWVQQKPGKSPRGLIGGTN<br>KRAPGVPARFSGSLLGGKAALTISGAQPEDEADYYCALW<br>YSNHWVFGGGTKLTVLGGGGSGGGGSGGGGSGGGGSE<br>VQLVESGGGSVQPGGSLRLSCAASGFTFSTYAMNWVRQA<br>PGKGLEWVGRIRSKANNYATYYADSVKGRFTISRDDSKN<br>TLYLQMNSLRAEDTATYYCVRHGNFGDSYVSWFAYWG<br>QGTTVTVSS |

Example 9—Expression of Antibodies as Monovalent Monospecific Fabs or Bispecific Antibodies The monovalent monospecific antibodies were expressed in a Fab format. Additionally, bispecific antibodies including a CD3 binding moiety were expressed based on a Fab format, which is highly stable and an efficient heterodimerization scaffold. scFvs or sdAbs were fused to the C-terminal regions of the Fab. The rabbit variable domains were paired with human constant domains (heavy chain and kappa light chain) to generate the chimeric Fab, which binds to the target pMHC. An scFv with binding specificity to CD3 was linked to the C terminus of the Fab light chain constant region. The amino acid sequences of the constant domains, amino acid linker, and CD3 scFv are recited below in Table 7.

TABLE 7

Amino Acid Sequences For Generating Chimeric Fab

| Sequence ID | Sequence |
| --- | --- |
| Human constant kappa<br>SEQ ID NO: 186 | RTVAAPSVFIFPPSDEQLKSGTASVVCLLNNFYPR<br>EAKVQWKVDNALQSGNSQESVTEQDSKDSTYSL<br>SSTLTLSKADYEKHKVYACEVTHQGLSSPVTKSF<br>NRGEC |
| Human constant heavy<br>SEQ ID NO: 187 | ASTKGPSVFPLAPSSKSTSGGTAALGCLVKDYFPE<br>PVTVSWNSGALTSGVHTFPAVLQSSGLYSLSSVVT<br>VPSSSLGTQTYICNVNHKPSNTKVDKKVEPKSC |
| Linker (linking the CL to the scFv)<br>SEQ ID NO: 188 | GGGGS |
| CD3 scFv (CDR sequences are highlighted in bold, underlined text)<br>SEQ ID NO: 189 | AVVTQEPSLTVSPGGTVTLTCGSSTGAVTTSNYA<br>NWVQQKPGKSPRGLIGGTNKRAPGVPARFSGSLL<br>GGKAALTISGAQPEDEADYYCALWYSNHWVFG<br>GGTKLTVLGGGGSGGGGSGGGGSGGGGSEVQL<br>VESGGGSVQPGGSLRLSCAASGFTFSTYAMNWV<br>RQAPGKGLEWVGRIRSKANNYATYYADSVKGR<br>FTISRDDSKNTLYLQMNSLRAEDTATYYCVRHGN<br>FGDSYVSWFAYWGQGTTVTVSS |

Synthetic genes encoding for the different antibody chains (i.e., heavy chain and light chain) were constructed at Twist Bioscience Corporation and were separately cloned into the expression vectors for transient expression in HEK 293 6E cells. Expression vector DNA was prepared using conventional plasmid DNA purification methods (for example Qiagen HiSpeed plasmid maxi kit, cat. #12662).

The monospecific antigen binding proteins and bispecific antigen binding proteins including a CD3 binding moiety were expressed by transient co-transfection of the respective mammalian expression vectors in HEK293-6E cells, which were cultured in suspension using polyethylenimine (PEI 40 kD linear). The HEK293-6E cells were seeded at $1.7 \times 10^6$ cells/mL in Freestyle F17 medium supplemented with 2 mM L-Glutamine. The DNA for every mL of the final production volume was prepared by adding DNA and PEI separately to 50 μL medium without supplement. Both fractions were mixed, vortexed and rested for 15 minutes, resulting in a DNA:PEI ratio of 1:2.5 (1 μg DNA/mL cells). The cells and DNA/PEI mixture were put together and then transferred into an appropriate container which was placed in a shaking device (37° C., 5% $CO_2$, 80% RH). After 24 hours, 25 μL of Tryptone N1 was added for every mL of final production volume.

After 7 days, cells were harvested by centrifugation and sterile filtered. The antigen binding proteins were purified by an affinity step. For the affinity purification of Fab-based constructs, the supernatant was loaded on a protein CH column (Thermo Fisher Scientific, #494320005) equilibrated with 6 CV PBS (pH 7.4). After a washing step with the same buffer, the antigen binding protein was eluted from the column by step elution with 100 mM Citric acid (pH 3.0). The fractions with the desired antigen binding protein were immediately neutralized by 1 M Tris Buffer (pH 9.0) at 1:10 ratio, then pooled, dialyzed and concentrated by centrifugation.

After concentration and dialysis against PBS buffer, content and purity of the purified proteins were assessed by SDS-PAGE and size-exclusion HPLC. After expression in HEK293-6E cells, the proteins were purified by a single capture step and analyzed by analytical size exclusion chromatography.

Example 10—Generation of Llama-Derived Antibodies

In order to increase even more the probability for identifying antibodies able to specifically recognize the MAGE-A4 peptide complex, 2 llamas were immunized with the HLA A*02:01/GVYDGREHTV complex ("GVYDGREHTV" is disclosed as SEQ ID NO: 3). Each animal received at different timepoints 4 injections of the pMHC complex protein described in Example 1 with complete or incomplete Freund's adjuvant. The immune response of the animals was tested in ELISA to quantify anti-HLA A*02:01/GVYDGREHTV antibodies present in serum samples of the immunized animals ("GVYDGREHTV" is disclosed as SEQ ID NO: 3). Antibody titers in sera indicated excellent immune responses.

Blood samples were obtained from the llamas, RNA was isolated from the plasma cells from the immunized animals and transcribed into cDNA using a reverse transcriptase Kit. The cDNA of the heavy chain fragments were amplified using primers annealing at the leader sequence region and at the CH2 region. The amplified DNA sequences coding for the VHH antibodies from llamas were used as a repertoire source for antibody library construction. Briefly, DNA sequences were digested using appropriate restriction enzymes were subsequently ligated into the phagemid vectors. The antibody libraries were screened as describe in Example 8. The antibody amino acid sequences are recited below in Table 8.

TABLE 8

Llama-Derived VHH Amino Acid Sequences. CDR sequences are highlighted in bold underlined text.

| Antibody ID | Sequence |
|---|---|
| M0734 SEQ ID NO: 190 | MEVQLVESGGGLVQAGGSLRVSCAASGLTFSNYAMGWF QQAPGKEREFVAGISWSGVSTYYADFVKGRFTISRDNAK NTVYLQMNSLKPEDTAVYYCAADNRRYSRGTSISTWRS DYDYWGQGTQVTVSS |
| M0734 CDRH1 SEQ ID NO: 191 | SNYAMG |
| M0734 CDRH2 SEQ ID NO: 192 | GISWSGVSTYYADFVKG |
| M0734 CDRH3 SEQ ID NO: 193 | DNRRYSRGTSISTWRSDYDY |
| M0735 SEQ ID NO: 194 | MEVQLVESGGGLVQAGGSLRLSCAASGLTFRRYTMGWF RQAPGKEREFVAAIVSSDSTNYADSVKGRFTISRDNAKNT VYLEMNSLKPDDTCVYYCAARNSLSLYVSNLGSRYDYW GQGTQVTVSS |
| M0735 CDRH1 SEQ ID NO: 195 | RRYTMG |
| M0735 CDRH2 SEQ ID NO: 196 | AIVSSDSTNYADSVKG |
| M0735 CDRH3 SEQ ID NO: 197 | RNSLSLYVSNLGSRYDY |

TABLE 8-continued

Llama-Derived VHH Amino Acid Sequences. CDR sequences are highlighted in bold underlined text.

| Antibody ID | Sequence |
|---|---|
| M0736<br>SEQ ID NO: 198 | MEVQLVESGGGLVQAGGSLRLSCTVSGRTSSAFAMGWFRQAPGKEREFVAAINLTGGTTNYAESVKGRFTISRDNAKNTGYLGMSSLKPEDTAVYYCAGRNRWSEGREVAPSSYYYWGQGTQVTVSS |
| M0736 CDRH1<br>SEQ ID NO: 199 | SAFAMG |
| M0736 CDRH2<br>SEQ ID NO: 200 | AINLTGGTTNYAESVKG |
| M0736 CDRH3<br>SEQ ID NO: 201 | RNRWSEGREVAPSSYYY |
| M0737<br>SEQ ID NO: 202 | MEVQLVESGGGLVQRGDSRRLSCAASGRPFSSFAMGWFRQAPGKEREFVAGISRSAGNTDYSDSVKGRFTISRDNAKNTVYLELNNLTPEDTAVYYCAAQIAIGTGSVFQSNTQYMYWGQGIQVTVSS |
| M0737 CDRH1<br>SEQ ID NO: 203 | SSFAMG |
| M0737 CDRH2<br>SEQ ID NO: 885 | GISRSAGNTDYSDSVKG |
| M0737 CDRH3<br>SEQ ID NO: 204 | QIAIGTGSVFQSNTQYMY |
| M0738<br>SEQ ID NO: 205 | MEVQLVESGGGLVEAGVSLRLSCAASGRTSENFAMGWFRQAPGNEREFVAAITRNHRTFYKESVKDRFTISRDDAKNTVYLEMNNLVPDDTAVYTCAAKFDPYASASSYYTGYYYWGQGTQVTVSS |
| M0738 CDRH1<br>SEQ ID NO: 206 | ENFAMG |
| M0738 CDRH2<br>SEQ ID NO: 207 | AITRNHRTFYKESVKD |
| M0738 CDRH3<br>SEQ ID NO: 208 | KFDPYASASSYYTGYYY |
| M0739<br>SEQ ID NO: 209 | MEVQLVESGGGSVQPGGSLRLSCAASGFTFSRSTMSWVRQAPGKGLEWVSSISGSGGVTTYTTSVKGRFTISRDNAKNLMYLQMNSLNPEDTAVYYCANGDNRGPGTQVTVSS |
| M0739 CDRH1<br>SEQ ID NO: 210 | SRSTMS |
| M0739 CDRH2<br>SEQ ID NO: 211 | SISGSGGVTTYTTSVKG |
| M0739 CDRH3<br>SEQ ID NO: 212 | GDN |
| M0740<br>SEQ ID NO: 213 | MEVQLVESGGGLVQPGGSLRLSCLASGPPFSMYTMNWVRQAPGKGLEWVSAISSGGAVTTYADSVKGRFTISRDNAKNTLYLQMSSLKPEDTAVYYCESSNNRGQGTQVTVSS |
| M0740 CDRH1<br>SEQ ID NO: 214 | SMYTMN |
| M0740 CDRH2<br>SEQ ID NO: 215 | AISSGGAVTTYADSVKG |
| M0740 CDRH3<br>SEQ ID NO: 216 | SNN |
| M0741<br>SEQ ID NO: 217 | MEVQLVESGGGAVQAGGSQRLSCTVSGRPFTKYAMGWFRQPPEKEREFVATSTWEGSTYYADSVKGRFTISRDNANNIIDLQMNTLKPEDTAVYFCAASNTYNADTTYYAKSTAFNFWGQGTQVTVSS |
| M0741 CDRH1<br>SEQ ID NO: 218 | TKYAMG |

TABLE 8-continued

Llama-Derived VHH Amino Acid Sequences. CDR sequences
are highlighted in bold underlined text.

| Antibody ID | Sequence |
|---|---|
| M0741 CDRH2<br>SEQ ID NO: 219 | TSTWEGSTYYADSVKG |
| M0741 CDRH3<br>SEQ ID NO: 220 | SNTYNADTTYYAKSTAFNF |
| M0742<br>SEQ ID NO: 221 | MEVQLVESGGGLVQPRGSLRLSCAASGFTFSNSGMSWVR<br>QAPGKGLEWVSSISSGGSSTTYLDSVKGRFTISRDNAKNT<br>LYLQMNSLKPEDTAVYYCWADLRGRGTQVTVSS |
| M0742 CDRH1<br>SEQ ID NO: 222 | SNSGMS |
| M0742 CDRH2<br>SEQ ID NO: 223 | SISSGGSSTTYLDSVKG |
| M0742 CDRH3<br>SEQ ID NO: 224 | ADL |
| M0743<br>SEQ ID NO: 225 | MEVQLVESGGGLVQPGGSLRLSCVASGFTFSWYTMNWV<br>RQAPGKGFEWVASIGSGGTPTTYRESVKGRFTISRDNAK<br>STLYLQMNSLKPEDTAVYHCENGQARGQGTQVTVSS |
| M0743 CDRH1<br>SEQ ID NO: 226 | SWYTMN |
| M0743 CDRH2<br>SEQ ID NO: 227 | SIGSGGTPTTYRESVKG |
| M0743 CDRH3<br>SEQ ID NO: 228 | GQA |
| M0744<br>SEQ ID NO: 229 | MEVQLVESGGGLVQPGGSLRLSCAASGSIFSINDMDWYR<br>QAPGKQRELVAAITRGGSTNYADSVKGRFTISRDNAKNT<br>VYLQMNSLKPEDTAVYYCNAEVSTETTGWRTWRDYWG<br>QGTQVTVSS |
| M0744 CDRH1<br>SEQ ID NO: 230 | SINDMD |
| M0744 CDRH2<br>SEQ ID NO: 231 | AITRGGSTNYADSVKG |
| M0744 CDRH3<br>SEQ ID NO: 232 | EVSTETTGWRTWRDY |
| M0745<br>SEQ ID NO: 233 | MEVQLVESGGGLVQAGGSLRLSCAVSGRRVSIYGMGWY<br>RLAPGKQREMVASITSGGITTYADSVKGRFSISRDNAKNT<br>VYLQMNSLKPEDTAVYYCNYHDRVQGESWGQGTQVT<br>VSS |
| M0745 CDRH1<br>SEQ ID NO: 234 | SIYGMG |
| M0745 CDRH2<br>SEQ ID NO: 235 | SITSGGITTYADSVKG |
| M0745 CDRH3<br>SEQ ID NO: 236 | HDRVQGES |
| M0746<br>SEQ ID NO: 237 | MEVQLVESGGGLVQAGGSLRLSCAASGRTFSNNAMGWF<br>RQGPDQEREFVAAISRSGGGSGGAPLYADSVKGRFTISRD<br>NAKNTMSLSMNSLSPEDTAVYYCAARSLYKVAGSDDLS<br>DYAYWGQGTQVTVSS |
| M0746 CDRH1<br>SEQ ID NO: 238 | SNNAMG |
| M0746 CDRH2<br>SEQ ID NO: 239 | AISRSGGGSGGAPLYADSVKG |
| M0746 CDRH3<br>SEQ ID NO: 240 | RSLYKVAGSDDLSDYAY |

TABLE 8-continued

Llama-Derived VHH Amino Acid Sequences. CDR sequences are highlighted in bold underlined text.

| Antibody ID | Sequence |
|---|---|
| M0747<br>SEQ ID NO: 241 | MEVQLVESGGGLAQAGGSLRVSCVASGRPFTKYAWGWF RQAPGKAREFVATITWDGGKTDYADSVKGRFTISKDSAE NSIYLQMNSLKPEDTAVYYCAADRNYCVGHRCYVRPDD YDYWGQGTQVTVSS |
| M0747 CDRH1<br>SEQ ID NO: 242 | TKYAWG |
| M0747 CDRH2<br>SEQ ID NO: 243 | TITWDGGKTDYADSVKG |
| M0747 CDRH3<br>SEQ ID NO: 244 | HRCYVRPDDYDY |
| M0748<br>SEQ ID NO: 245 | MEVQLVESGGGAVQAGGSLRLSCTVSGRPFTKYAWGWF RQPPEKEREFVATSTWDVGSTYYADSAKGRFTISRDNAN NIIDLQMNSLKPEDTAVYYCAASNTYSSDITYYAKPMAF NFWGQGTQVTVSS |
| M0748 CDRH1<br>SEQ ID NO: 246 | TKYAWG |
| M0748 CDRH2<br>SEQ ID NO: 247 | TSTWDVGSTYYADSAKG |
| M0748 CDRH3<br>SEQ ID NO: 248 | SNTYSSDITYYAKPMAFNF |
| M0749<br>SEQ ID NO: 249 | MEVQLVESGGGSVQPGGSLRLSCAASGTFSRSTMSWVR QAPGKEIEWVSSVSGSGGVTTYADSVKGRFTISRDNAKN TLYLQMSSLKPEDTAVYYCGNSNARGQGTQVTVSS |
| M0749 CDRH1<br>SEQ ID NO: 250 | SRSTMS |
| M0749 CDRH2<br>SEQ ID NO: 251 | SVSGSGGVTTYADSVKG |
| M0749 CDRH3<br>SEQ ID NO: 252 | SNA |
| M0750<br>SEQ ID NO: 253 | MEVQLVESGGGLVQPGGSLRLSCAASGFTFSRYTMSWVR QAPGEGLEWVSSIGSGGGPTTYANSVKGRFTVSRDNAKN TLWLQMNNLKPEDTALYYCQGGNRGQGAQVTVSS |
| M0750 CDRH1<br>SEQ ID NO: 254 | SRYTMS |
| M0750 CDRH2<br>SEQ ID NO: 255 | SIGSGGGPTTYANSVKG |
| M0750 CDRH3<br>SEQ ID NO: 256 | GGN |
| M0751<br>SEQ ID NO: 257 | MEVQLVESGGGLVQPGGSLRLSCAASGFSFRLYTMSWVR QAPGKGLEWVSSISSGGGVVTTYADSAKGRFTISRDNDK NTLTLQMNSLKPEDTAVYYCAQGERRGQGTQVTVSS |
| M0751 CDRH1<br>SEQ ID NO: 258 | RLYTMS |
| M0751 CDRH2<br>SEQ ID NO: 259 | SISSGGGVVTTYADSAKG |
| M0751 CDRH3<br>SEQ ID NO: 260 | GER |
| M0752<br>SEQ ID NO: 261 | MEVQLVESGGGLVQPGGSLRLSCAASGFTFSNYGMSWVR QAPGKGLEWVSSIGSGGRITTYLDSVKGRFTISRDNAKNT LYLQMNSLKSEDTAVYYCESGGYRGQGTQVTVSS |

TABLE 8-continued

Llama-Derived VHH Amino Acid Sequences. CDR sequences are highlighted in bold underlined text.

| Antibody ID | Sequence |
|---|---|
| M0752 CDRH1<br>SEQ ID NO: 262 | SNYGMS |
| M0752 CDRH2<br>SEQ ID NO: 263 | SIGSGGRITTYLDSVKG |
| M0752 CDRH3<br>SEQ ID NO: 264 | GGY |
| CDR4-bispecific<br>02 (M0711 HC)<br>SEQ ID NO: 343 | EVQLVESGGGSVQPGGSLRLSCAASGFTFSTYAMNWVRQ<br>APGKGLEWVGRIRSKANNYATYYADSVKGRFTISRDDSK<br>NTLYLQMNSLRAEDTATYYCVRHGNFGDSYVSWFAYW<br>GQGTTVTVSSASTKGPSVFPLAPSSKSTSGGTAALGCLVK<br>DYFPEPVTVSWNSGALTSGVHTFPAVLQSSGLYSLSSVVT<br>VPSSSLGTQTYICNVNHKPSNTKVDKRVEPKSC |
| CDR4-bispecific<br>02 (M0711 LC)<br>SEQ ID NO: 344 | EVQLVESGGGLVQAGGSLRVSCAASGLTFSNYAMGWFQ<br>QAPGKEREFVAGISWSGVSTYYADFVKGRFTISRDNAKN<br>TVYLQMNSLKPEDTAVYYCAADNRRYSRGTSISTWRSD<br>YDYWGQGTQVTVSSGGGGSAVVTQEPSLTVSPGGTVTLT<br>CGSSTGAVTTSNYANWVQQKPGKSPRGLIGGTNKRAPG<br>VPARFSGSLLGGKAALTISGAQPEDEADYYCALWYSNHW<br>V**FGGGTKLTVLGTVAAPSVFIFPPSDEQLKSGTASVVCLLN<br>NFYPREAKVQWKVDNALQSGNSQESVTEQDSKDSTYSLS<br>STLTLSKADYEKHKVYACEVTHQGLSSPVTKSFNRGEC |

Example 11—Characterization of Hits

Figure 4:
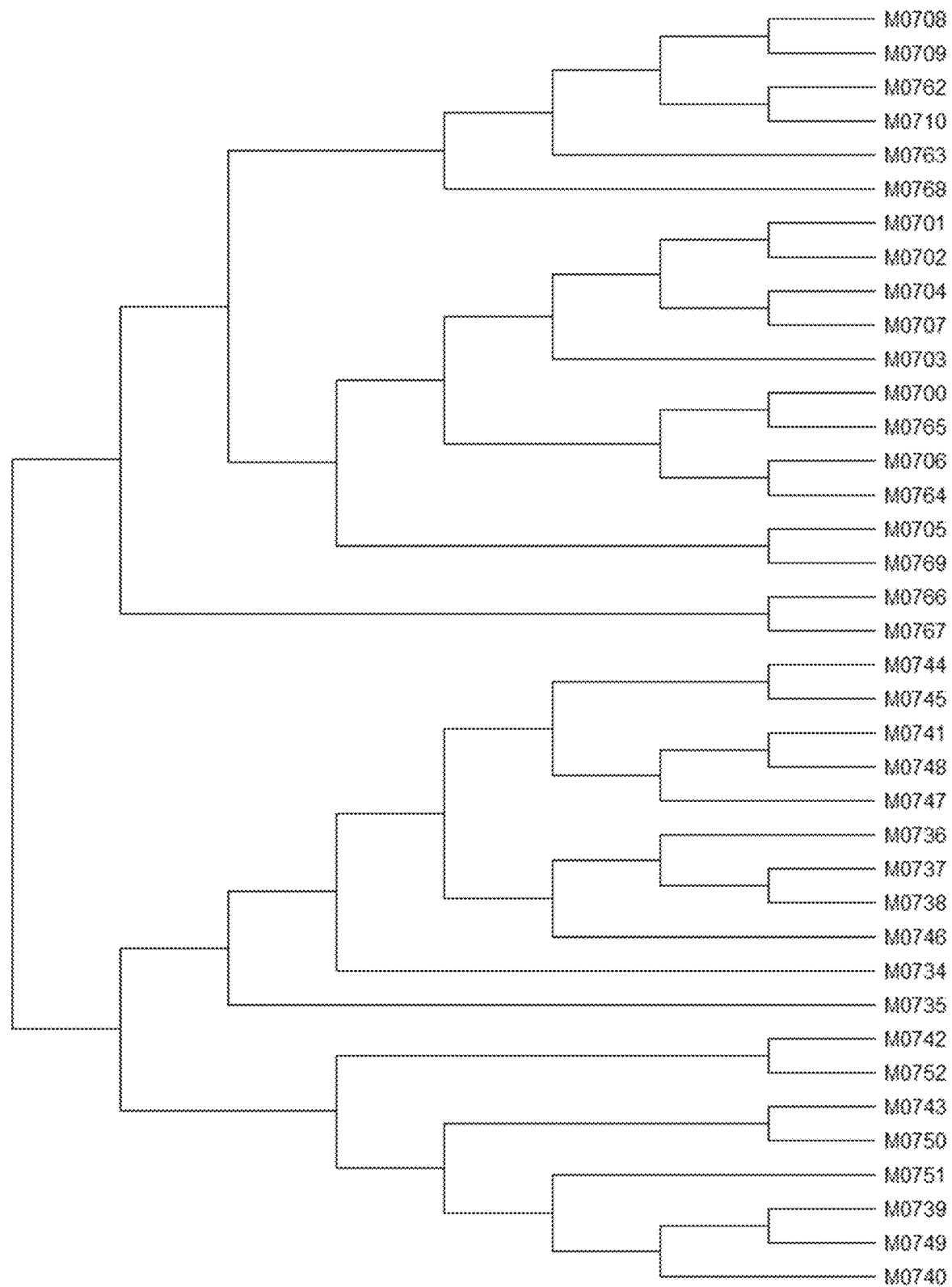
FIG. 4 depicts a selection of 38 unique HLA-A2/MAGE-A4 specific antibodies generated via rabbit and llama immunizations, followed by construction and biopanning of the respective phage libraries. Selected hits were grouped according to the amino acid sequence diversity, as determined by the phylogenetic analysis.

Phylogenetic analysis of the selected 38 HLA-A2/MAGE-A4 binding hits originating from the rabbit and llama immunization libraries was performed using the Maximum Likelihood method based on a Jones-Taylor-Thornton (JTT) model (MEGAX software). Sequence diversity of the selected binders is depicted in FIG. 4. Selected hits represent a collection HLA-A2/MAGE-A4 binders with high sequence diversity and distinct origins.

Figure 5A:
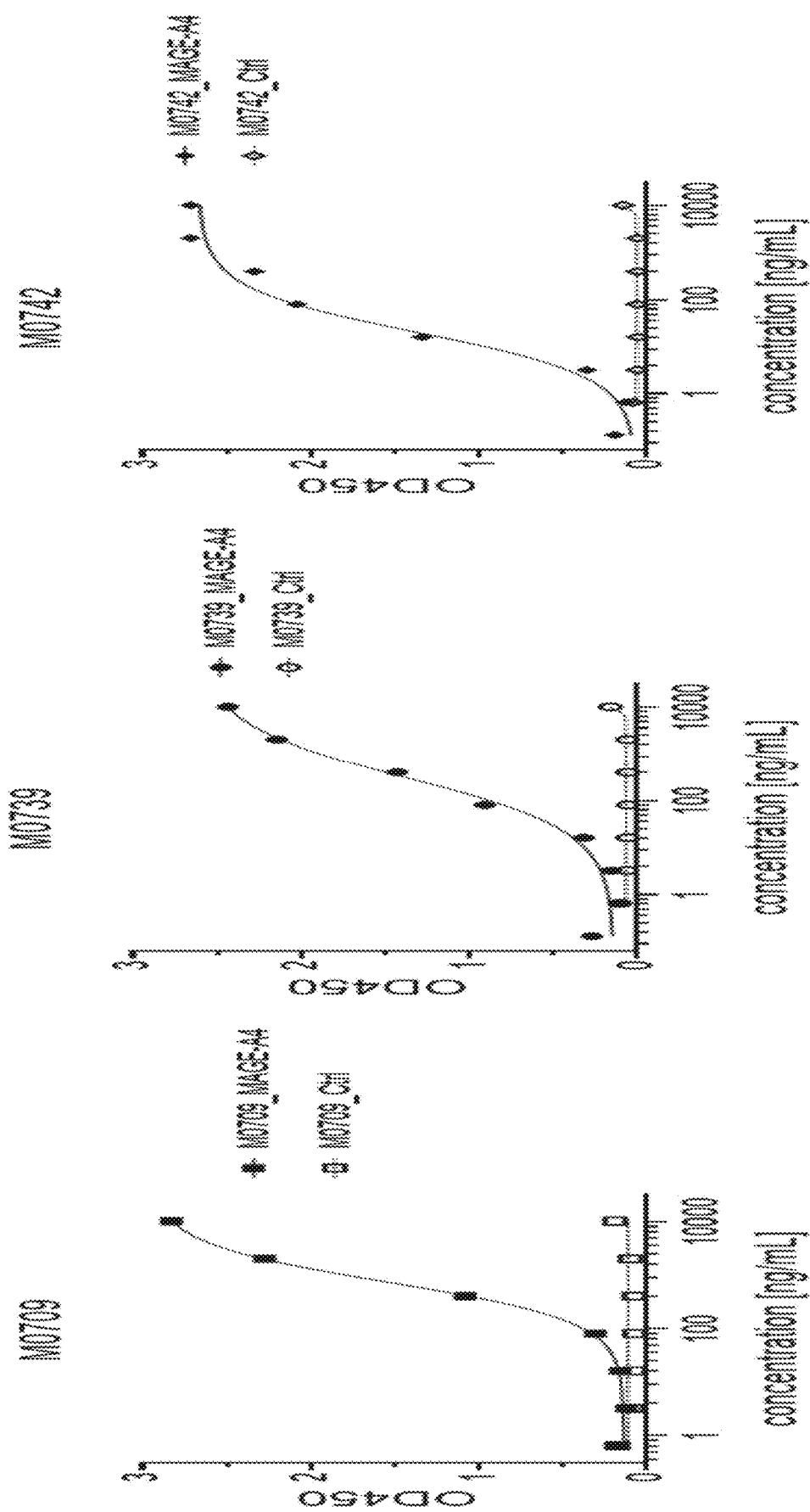
FIG. 5A-FIG. 5B depicts binding of selected antibodies to HLA-A2/MAGE-A4 or control complex, as determined by direct ELISA. Antibodies designated M0709, M0739, M0742, M0743, M0747, and M0763 are shown in FIG. 5A and antibodies designated M0700-M0710 and M0762-M0766 are shown in FIG. 5B.
Figure 5A:
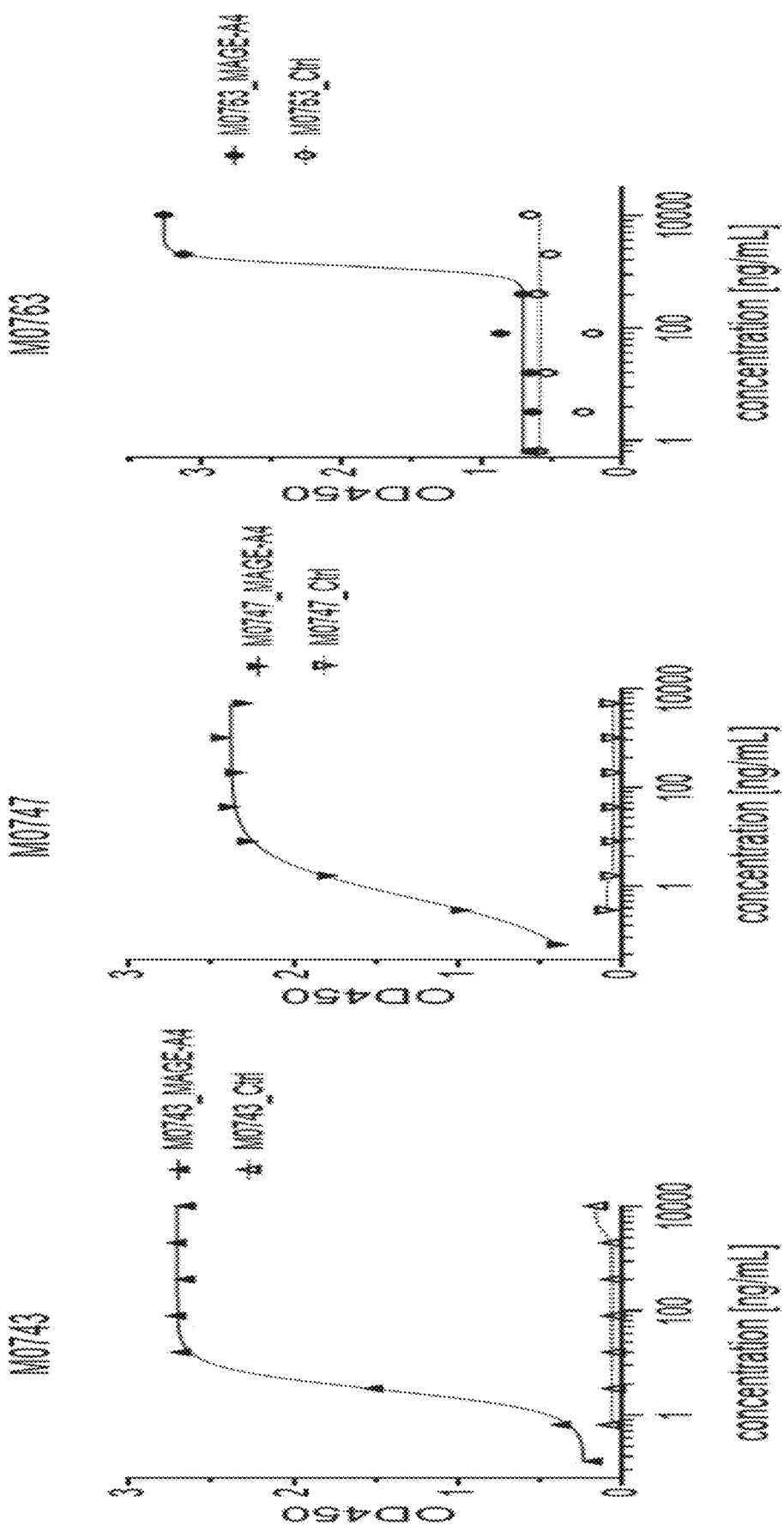
Figure 5B:
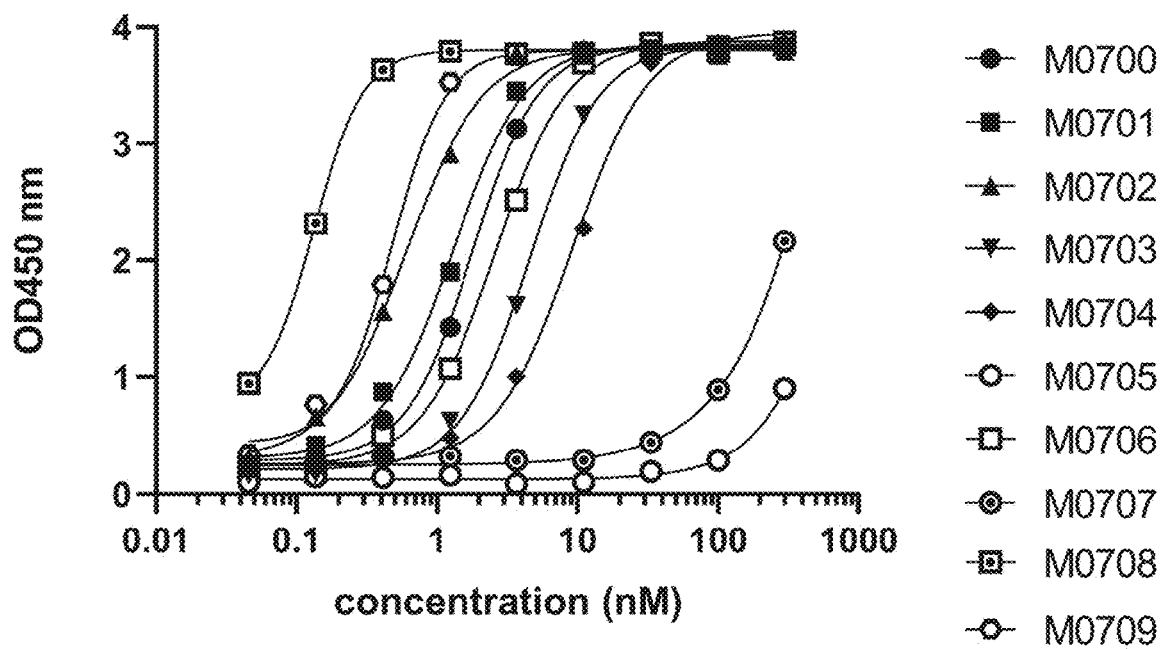
Figure 5B:
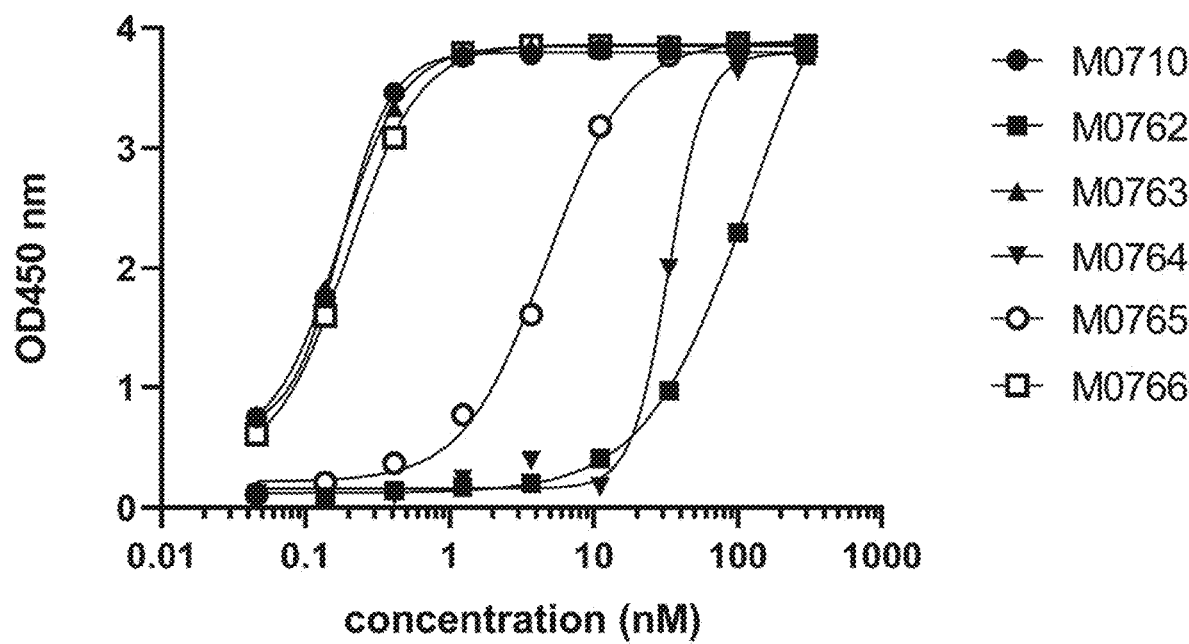
Figure 5B:
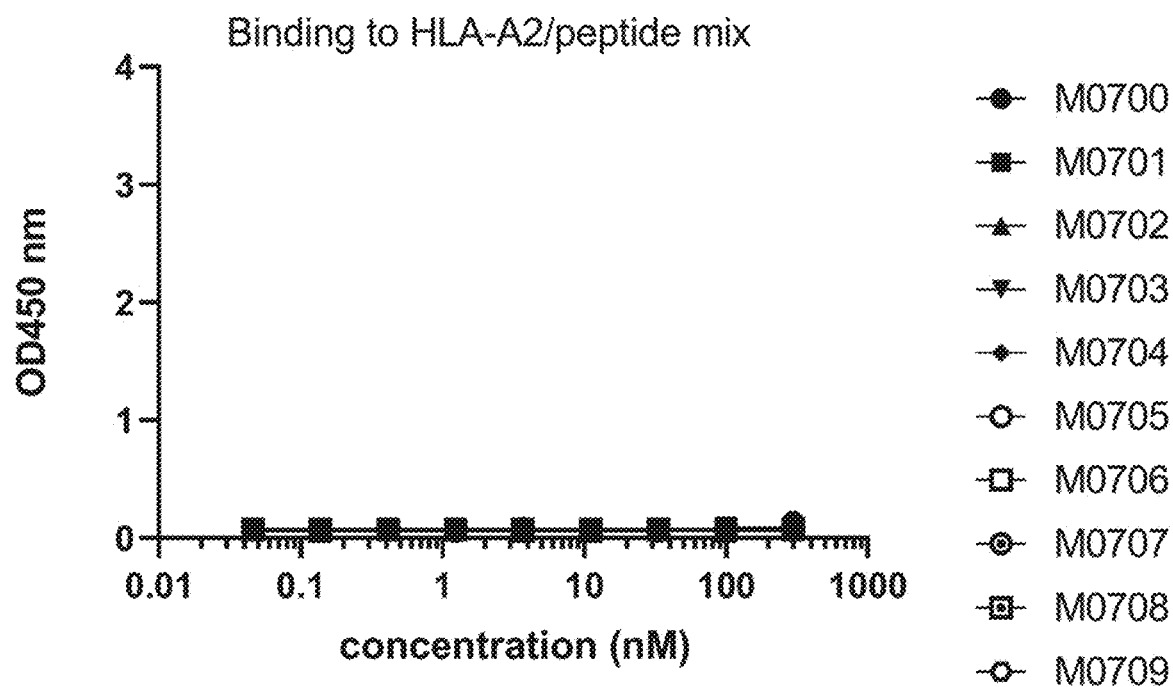
Figure 5B:
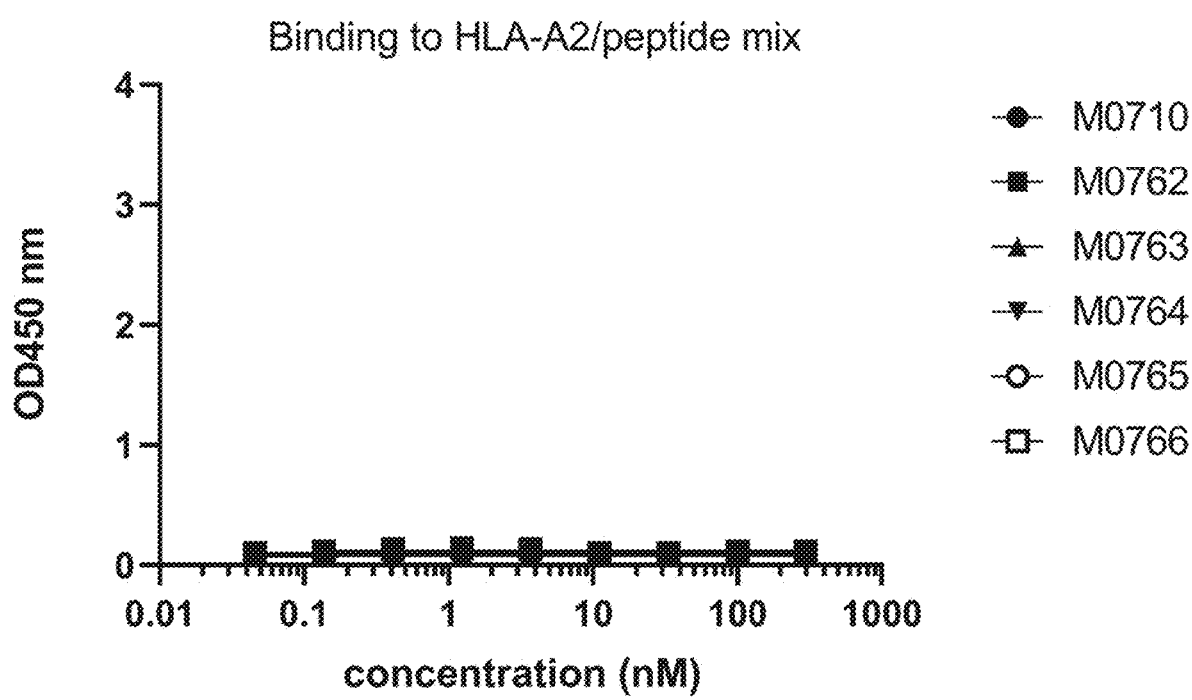

All available hits were evaluated for their ability to bind MAGE-A4/HLA-A2 complex and a control peptide/HLA-A2 complex in a direct binding ELISA assay. The control peptide/HLA-A2 complex in this assay comprised an HLA-A2 complex loaded with a mixture of 49 unrelated peptides, as recited in Table 9 (SEQ ID NOs: 345-393). Briefly, 96 well ELISA plates were coated with purified human MAGE-A4/HLA-A2 complex or control HLA-A2 complex. Serial dilutions of antibody molecules were added to the plate and detected by an anti-kappa light chain-HRP (Invitrogen) or a purified rabbit anti-VHH (QVQ) followed by goat anti-rabbit IgG(H+L) HRP (Southern Biotech). Binders were considered for further characterization when showing high binding to MAGE-A4/HLA-A2 complex and no binding to control peptide/HLA-A2 complex. Binding of the six select antibodies M0709, M0739, M0742, M0743, M0747 and M0763 to HLA-A2/MAGE-A4 complex, as determined by ELISA, is shown in FIG. 5A. Binding of additional antibodies designated M0700-M0710 and M0762-M0766 to HLA-A2/MAGE-A4 complex, as determined by ELISA, is shown in Figure. 5B. All tested molecules showed specific binding to the HLA-A2/MAGE-A4 complex and no binding to the control HLA-A2 complex. Each of the tested antibodies contained a kappa light chain, with the exception of M0709 and M0763, which contained a lambda light chain.

Figure 6:
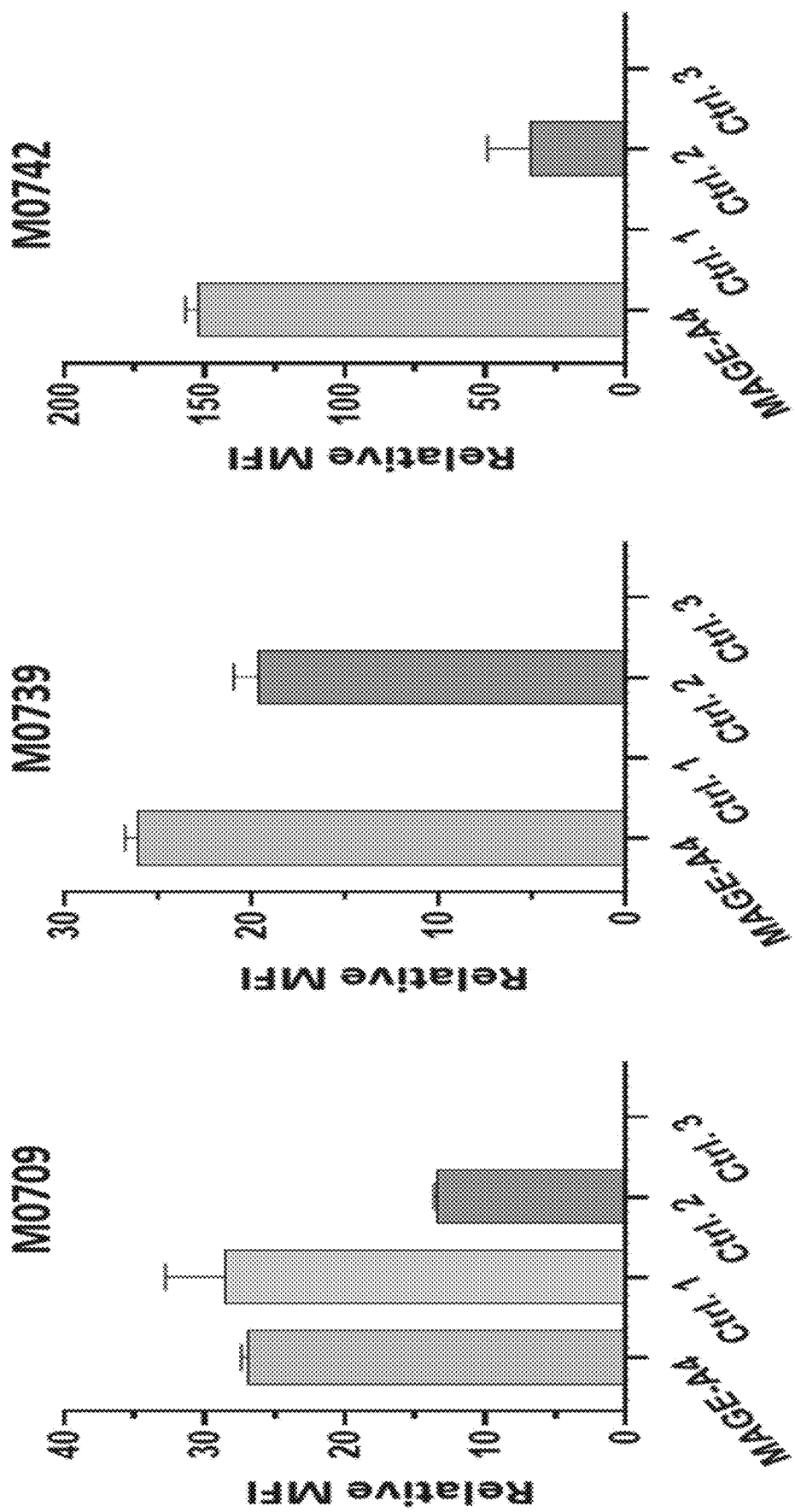
FIG. 6 depicts binding of the selected antibodies M0709, M0739, M0742, M0743, M0747, M0763 to T2 cells displaying MAGE-A4 or control peptides 1, 2 and 3. TAP-deficient T2 cells were pulsed with HLA-A2-restricted peptides (MAGE-A4 or control peptides) and incubated with MAGE-A4 binders followed by fluorophore-labeled specific detection antibodies and analysis by flow cytometry. Peptide loading was confirmed with PE-labeled anti-HLA-A2 antibody BB7.2. Results of the ratio of binding efficiency over peptide loading capacity are shown as Relative Median Fluorescence Intensity (MFI).
Figure 6:
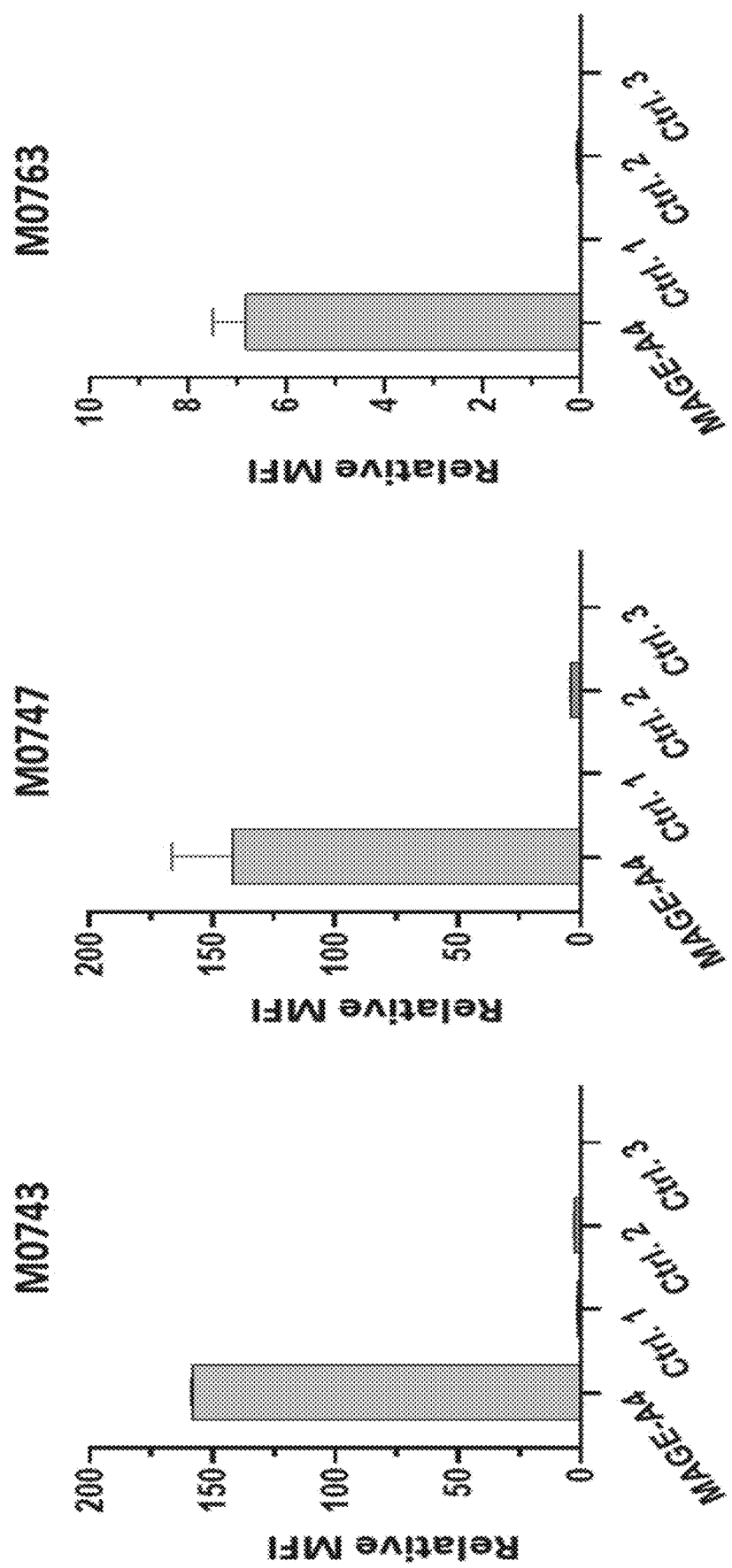

Binding of the specific antibodies M0709, M0739, M0742, M0743, M0747 and M0763 to the MAGE-A4 peptide-HLA-A2 complex presented on cells was determined. Briefly, T-B hybrid T2 cells were incubated with serum-free RPMI1640 medium containing MAGE-A4 or control peptides. Control peptides constituted sequences with high identity to MAGE-A4 and had previously been identified in healthy human tissues, i.e., Ctrl. 1 (GLADGRTHTV; SEQ ID NO: 394), Ctrl.2 (GLYDGPVHEV; SEQ ID NO: 395) and Ctrl.3 (GVFDG-LHTV; SEQ ID NO: 396) (US20180171024, incorporated herein by reference). Peptide loading efficiency was verified by using the ratio between median fluorescent intensity (MFI) of HLA-A2-binding antibody BB7.2 on peptide loaded T2 cells and MFI of unloaded T2 cells (>1). T2 cells were incubated with each of the specific antibodies followed by fluorophore-labeled detection antibodies (anti-kappa light chain or anti-Flag). The cells were fixed and fluorescence was measured by flow cytometry. Binding and specificity of the selected antibodies M0709, M0739, M0742, M0743, M0747, M0763 to the T2 cells displaying MAGE-A4 or control peptides 1, 2 and 3 is presented in FIG. 6. All tested molecules showed binding to the HLA-A2/MAGE-A4 displayed on the T2 cells. Moreover, M0743, M0747 and M0763 showed a very high specificity for the MAGE-A4 peptide and did not show binding to any of the control peptides displayed by the HLA-A2 on T2 cells. M0709 showed the lowest specificity of all tested molecules and was also binding control peptide 1 and 2. M0739 and M0742 both bound not only the MAGE-A4 displayed peptide but also the control peptide 2.

Example 12—Redirected T Cell Killing of Antigen-Positive and -Negative Cell Lines Using pHLA-Targeting Bispecific Antibodies Redirected T cell killing of tumor cell lines by peptide-HLA (pHLA) targeting bispecific antibodies was determined by endpoint cytotoxicity measurements (LDH release) and real-time imaging (IncuCyte).

Figure 7:
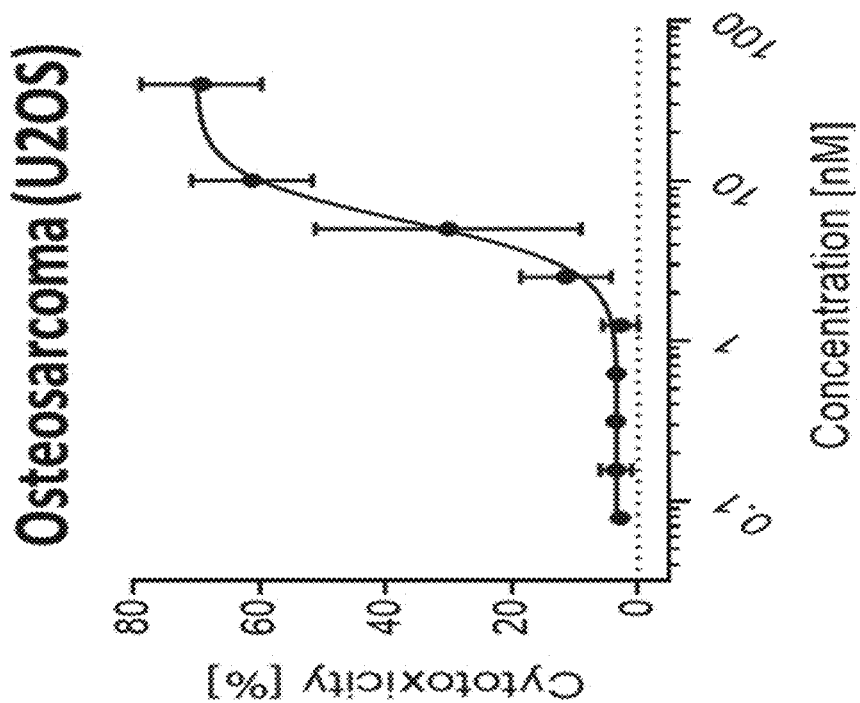
FIG. 7 depicts T cell-mediated cytotoxicity triggered by the CDR4-bispecific 01. Cell killing was determined by measuring the released LDH after 48 h of co-incubation of MAGE-A4 positive cell lines with PBMCs at E:T ratio 10:1 and CDR4-bispecific 01 at the indicated concentrations.
Figure 7:
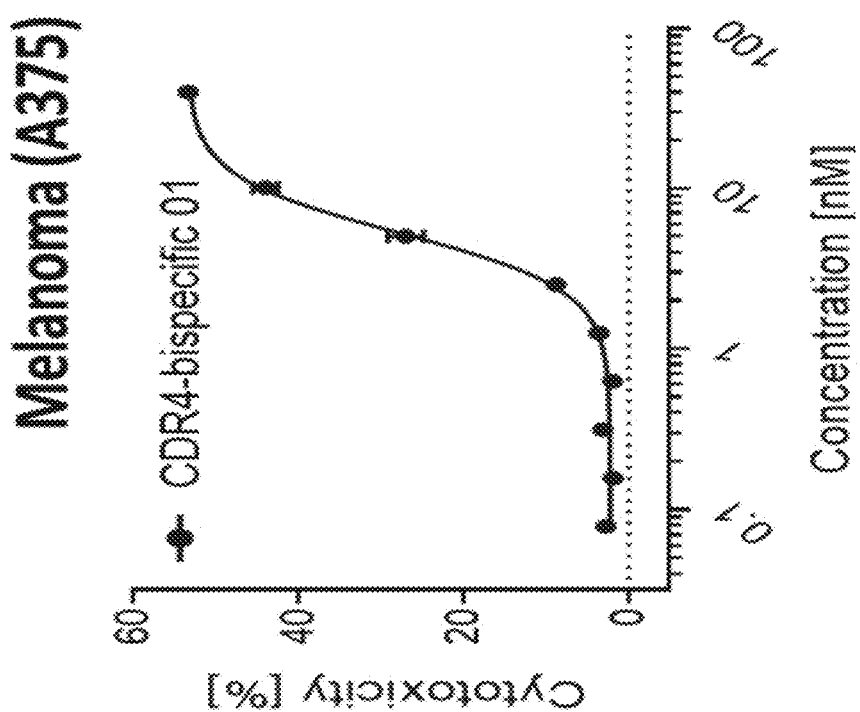
Figure 7:
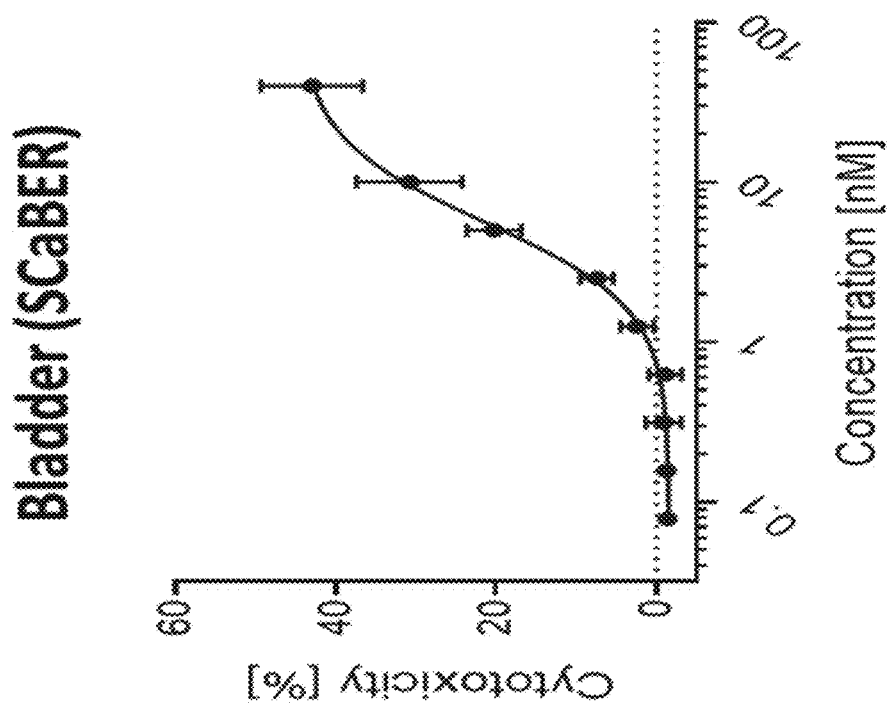
Figure 7:
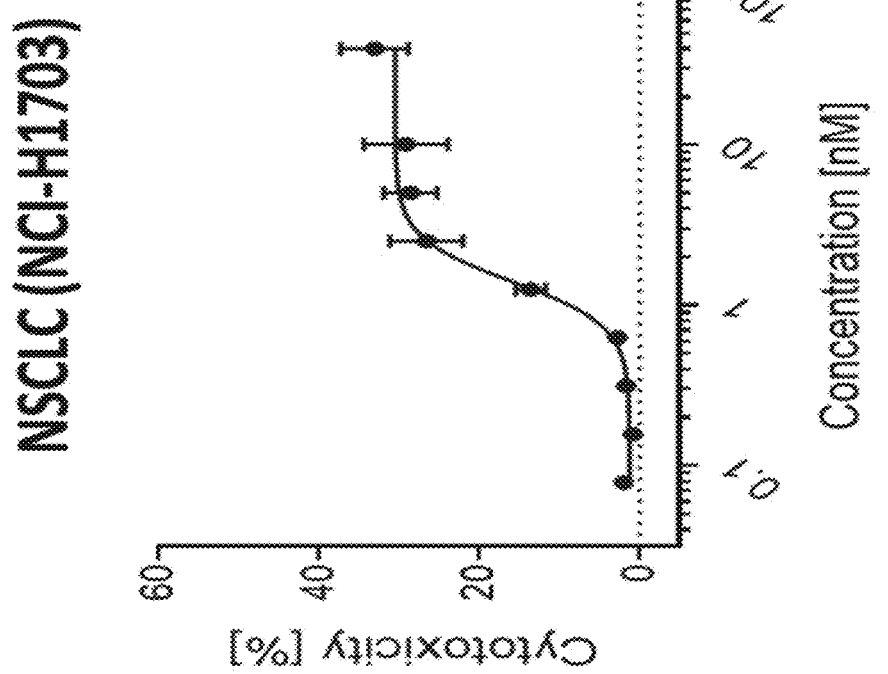

The Lactate Dehydrogenase release assay was performed. Briefly, target cells were co-cultured with effector cells (e.g., PBMCs) at an E:T ratio of about 10:1. Solutions of the CDR4-bispecific 01 antibody, M0719 covering a concentration range from 0.4 nM to 40 nM were added to the relevant wells. Cytotoxicity was quantified by colorimetric absorbance measurements of the amount of LDH released from damaged cells into the medium after 48 h. The analysis was performed on HLA-A2 expressing antigen-positive cell lines (e.g., A375 (melanoma), U2OS (osteosarcoma), SCaBER (bladder carcinoma) and NCI-H1703 (non-small cell lung adenocarcinoma). The obtained data is presented in FIG. 7. The tested antibody CDR4-bispecific 01 showed potent T cell mediated killing of antigen positive tumor cells, even at low concentrations.

Figure 8:
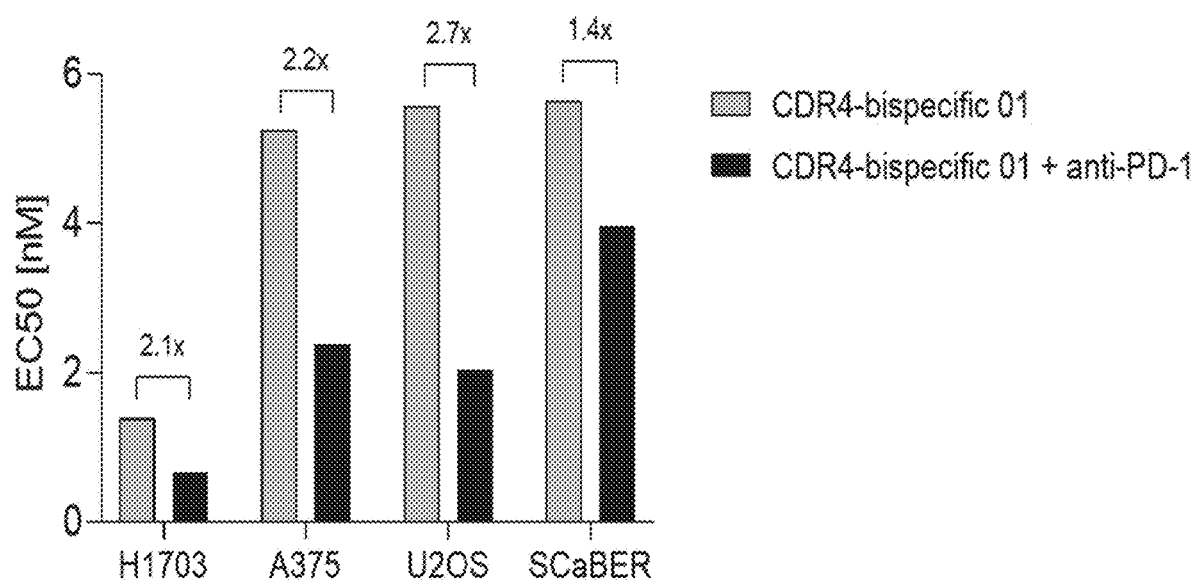
FIG. 8 depicts the EC50 values for cell killing, as determined by the LDH assay. The LDH release was measured after 48 h co-incubation of PBMCs and MAGE-A4 positive cell lines at E:T ratio 10:1 in presence of MAGE-A4 bispecific 01 with or without anti-PD-1 (Pembrolizumab).
Figure 9:
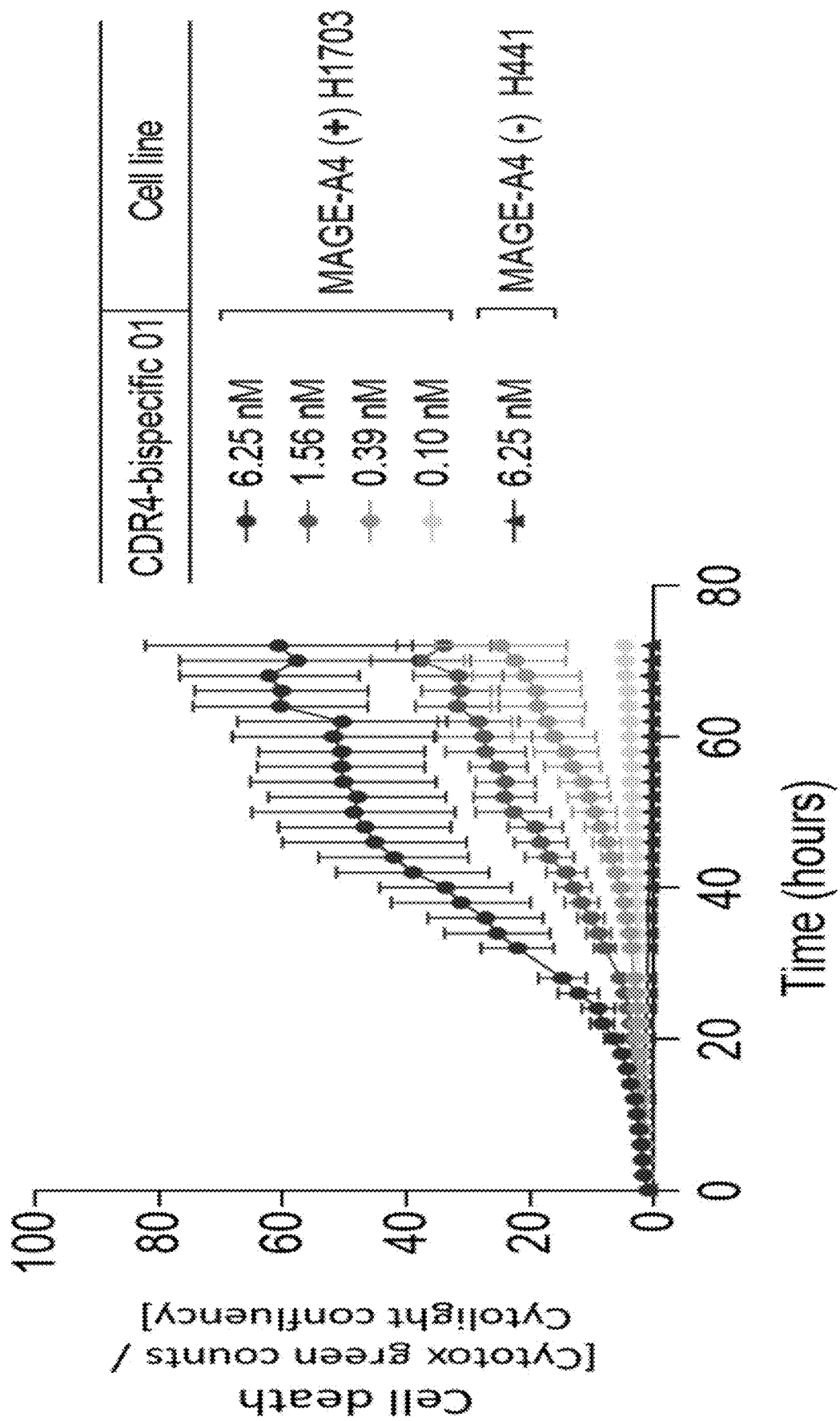
FIG. 9 depicts T cell-mediated cytotoxicity triggered by the CDR4-bispecific 01, as determined by live cell imaging in vitro. MAGE-A4 positive NCI-H1703 cells were co-incubated with PBMCs at E:T ratio 10:1 and CDR4-bispecific 01 at the indicated concentrations. Images were recorded by the IncuCyte S3 system for up to 72 h. Quantification of cytotoxicity is reported as ratio of green object count per image (dead cells, Cytotox Green Dye) to red area confluence (cell lines, Cytolight Rapid Red). MAGE-A4 negative/HLA-A2 positive H441 cells were used as control at the highest concentration (6.3 nM) of bispecific to demonstrate specific killing.

Moreover, CDR4-bispecific 01 was also tested in an LDH assay in combination with an immune checkpoint inhibitor pembrolizumab (anti-PD-1 antibody). Briefly, LDH assay was performed as described above. EC50 for cell killing was determined by LDH release after 48 h co-incubation of PBMCs and MAGE-A4 positive cell lines A375, U2OS, SCaBER and NCI-H1703 at E:T ratio 10:1 in the presence of MAGE-A4 bispecific 01 (concentrations ranging from 0.078 to 40 nM) with or without 300 nM anti-PD-1 antibody (pembrolizumab). The EC50 values for cell killing by CDR4-bispecific 01 and pembrolizumab with CDR4-bispecific 01 combination were plotted and are shown in FIG. 8. CDR4-bispecific 01 showed a synergistic killing of the HLA-A2/MAGE-A4 positive cells in combination with pembrolizumab with EC50 values at between 1.4-fold to 2.7-fold higher than CDR4-bispecific 01 alone. In addition, cell killing was analyzed in a time-resolved manner using the IncuCyte S3 system. Briefly, cells were seeded along with effector cells and treated with the bispecific antibodies, as described above. Briefly, antigen-positive target cells (e.g., NCI-H1703, A375) or antigen-negative target cells (e.g., NCI-H441, Panc-1) were incubated with Cytolight Rapid Red (Sartorius, #4706). CDR4-bispecific antibody 01 solutions were prepared at final concentrations between 6.25 nM and 0.1 nM and added to the relevant well. Cytotox Green Dye (Sartorius, #4633) was added to the PBMCs. The plate was imaged over time to monitor cell growth. The growth of cancer cells in each image was determined and recorded as red area confluence normalized to time 0. The number of apoptotic cells in each image was determined and recorded as green area per red area normalized to time 0. The tested bispecific antibody CDR4-bispecific 01 showed potent dose-dependent T cell mediated killing of antigen positive tumor cells over time, while no killing of antigen-negative cells was observed (FIG. 9).

Figure 10:
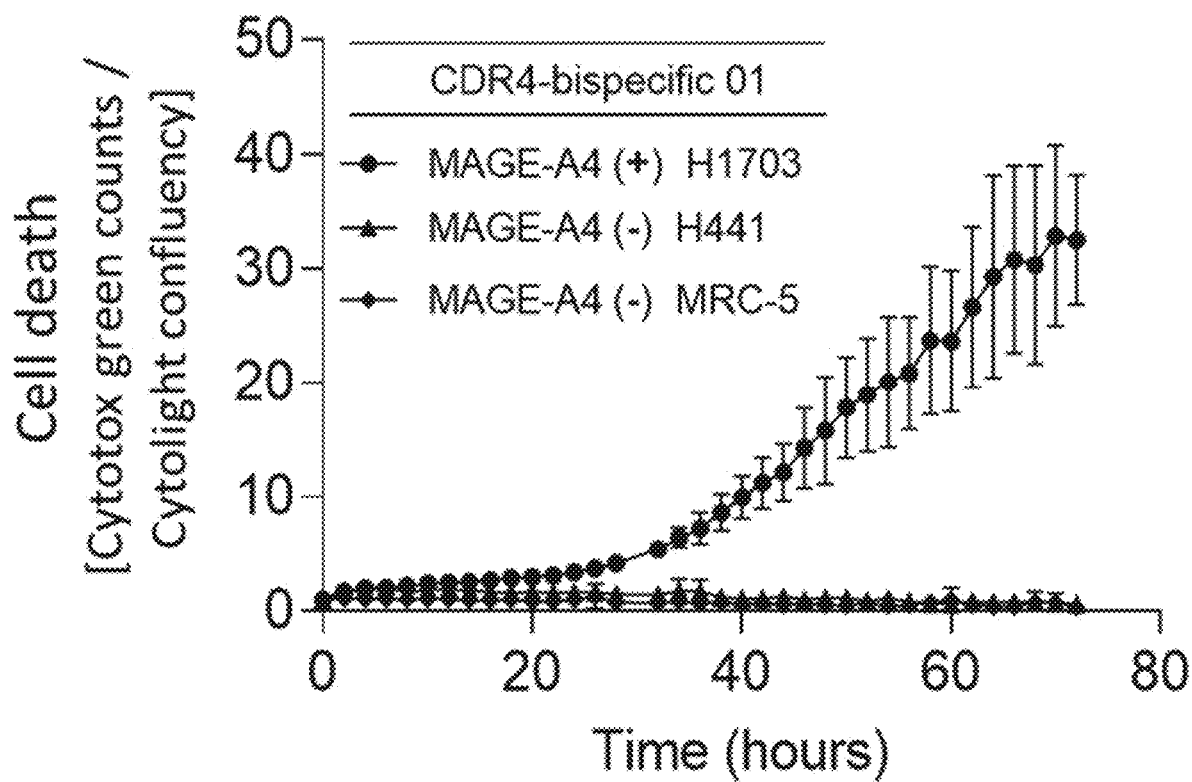
FIG. 10 depicts T cell-mediated cytotoxicity triggered by the CDR4-bispecific 01, as determined by live cell imaging in vitro. MAGE-A4 positive/HLA-A2 positive NCI-H1703 cells or MAGE-A4 negative/HLA-A2 positive cells (H441 and MRC5) were co-incubated with PBMCs at E:T ratio 10:1 and single concentrations of 0.8 nM CDR4-bispecific 01. Images were recorded with the IncuCyte S3 system for up to 72 h. Quantification of cytotoxicity is reported as ratio of green object count per image (dead cells, Cytotox Green Dye) to red area confluence (cell lines, Cytolight Rapid Red).

In addition, MAGE-A4 positive/HLA-A2 positive NCI-H1703 cells and MAGE-A4 negative/HLA-A2 positive cells (NCI-H441 (lung adenocarcinoma) and MRC5 (normal human fibroblasts)) were co-incubated with PBMCs (E:T 10:1) and CDR4-bispecific 01 at a concentration of 0.8 nM. Images were recorded with the IncuCyte S3 system for up to 72 h and the respective cytotoxicity is depicted in FIG. 10. CDR4-bispecific 01 demonstrated potent killing of MAGE-A4 positive/HLA-A2 positive NCI-H1703 cells and no killing of the control MAGE-A4 negative/HLA-A2 positive cancer cells NCI-H441 and normal fibroblasts MRC5, thus demonstrating good efficacy and safety.

Figure 11:
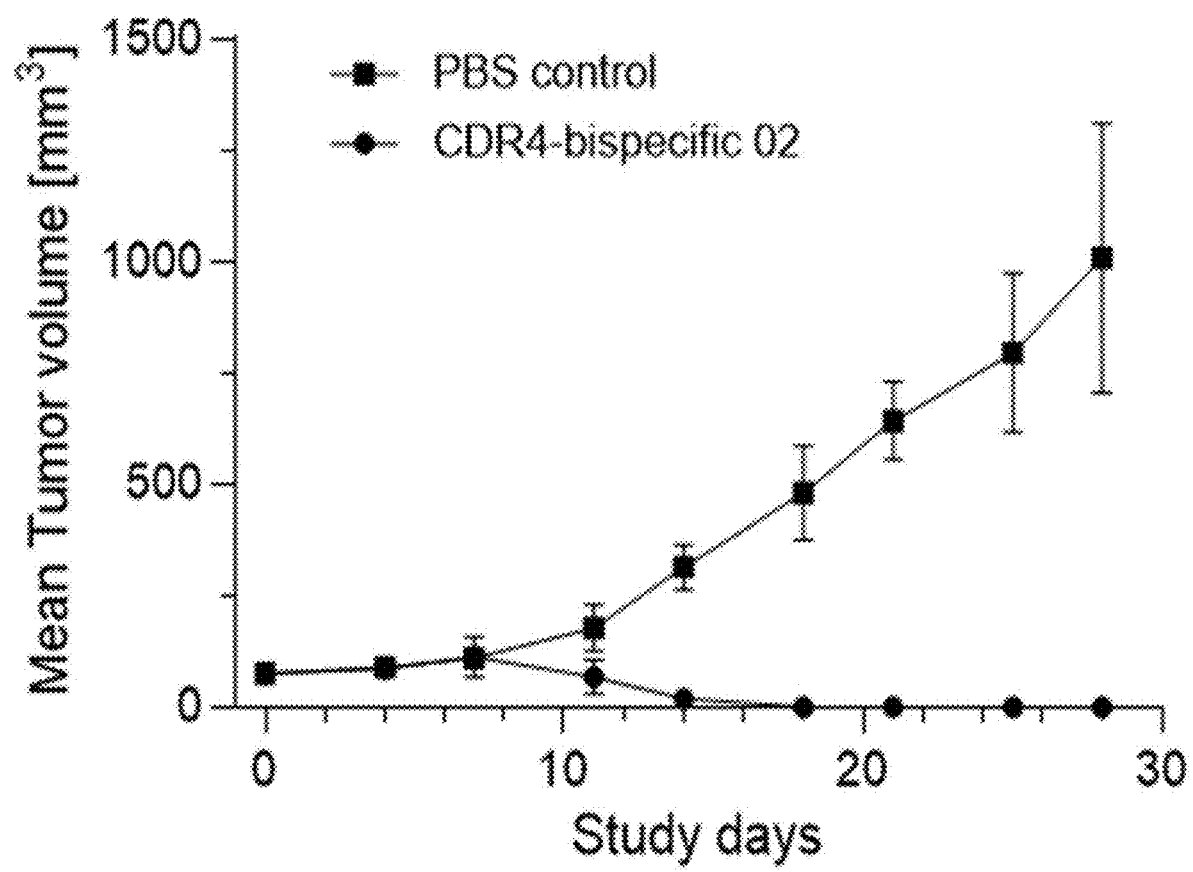
FIG. 11 depicts in vivo efficacy of the CDR4-bispecific 02 molecule. NSG mice were injected subcutaneously with $5 \times 10^6$ NCI-H1703 cells and received at an average tumor size of 80 mm³ $5 \times 10^6$ PBMCs intravenously (2 donors, 4 mice/group). Mice were treated once daily with CDR4-bispecific 02 (2.5 mg/kg day 0-9, 5 mg/kg day 10-27) or a PBS control.

Example 13—Efficacy of the pHLA-Targeting Bispecific Antibody Against Non-Small-Cell Lung Carcinoma (NSCLC) in Mice NSG mice were implanted subcutaneously with $5\times10^6$ NCI-H1703 cells. At an average tumor size of 80 mm³ (denoted as day 0) animals were randomized and received $5\times10^6$ PBMCs intravenously from a total of two donors with two mice per group per donor. Mice were treated once daily with CDR4-bispecific 02 (2.5 mg/kg day 0-9, 5 mg/kg day 10-27) or a PBS control. Body weights and tumor volume (by caliper) were measured twice per week. The in vivo efficacy of CDR4-bispecific 02 is presented in FIG. 11. CDR4-bispecific 02 showed a complete regression of a lung cancer tumor xenograft in mice.

TABLE 9

HLA complex control peptides

| SEQ ID NO: | Peptide Sequence |
|---|---|
| SEQ ID NO: 345 | GVRGRVEEI |
| SEQ ID NO: 346 | AVLDGLLSL |
| SEQ ID NO: 347 | FLYDDNQRV |
| SEQ ID NO: 348 | YMLDLQPETT |
| SEQ ID NO: 349 | ELAGIGILTV |
| SEQ ID NO: 350 | EAAGIGILTV |
| SEQ ID NO: 351 | LLGDLFGV |
| SEQ ID NO: 352 | FLWGPRALV |
| SEQ ID NO: 353 | SLYNTVATL |
| SEQ ID NO: 354 | SLYSYFQKV |
| SEQ ID NO: 355 | GLCTLVAML |
| SEQ ID NO: 356 | GILGFVFTL |
| SEQ ID NO: 357 | VLAGGFFLL |
| SEQ ID NO: 358 | FVGEFFTDV |
| SEQ ID NO: 359 | FLYALALLL |
| SEQ ID NO: 360 | YMDDVVLGV |
| SEQ ID NO: 361 | ALLTSRLRFI |
| SEQ ID NO: 362 | FLPSDFFPSV |
| SEQ ID NO: 363 | KIFGSLAFL |
| SEQ ID NO: 364 | SLLMWITQV |
| SEQ ID NO: 365 | RMFPNAPYL |
| SEQ ID NO: 366 | YMDGTMSQV |
| SEQ ID NO: 367 | VLFGLGFAI |
| SEQ ID NO: 368 | SLPPPGTRV |
| SEQ ID NO: 369 | VLEETSVML |
| SEQ ID NO: 370 | RMPEAAPPV |
| SEQ ID NO: 371 | ILKEPVHGV |
| SEQ ID NO: 372 | KTWGQYWQV |
| SEQ ID NO: 373 | SLLPIMWQL |
| SEQ ID NO: 374 | NLVPMVATV |
| SEQ ID NO: 375 | VLQELNVTV |
| SEQ ID NO: 376 | CINGVCWTV |

TABLE 9-continued

HLA complex control peptides

| SEQ ID NO: | Peptide Sequence |
|---|---|
| SEQ ID NO: 377 | LMLGEFLKL |
| SEQ ID NO: 378 | VLDFAPPGA |
| SEQ ID NO: 379 | LTLGEFLKL |
| SEQ ID NO: 380 | IMDQVPFSV |
| SEQ ID NO: 381 | CLGGLLTMV |
| SEQ ID NO: 382 | VTEHDTLLY |
| SEQ ID NO: 383 | FLLTKILTI |
| SEQ ID NO: 384 | WLSLLVQFV |
| SEQ ID NO: 385 | LLLLTVLTV |
| SEQ ID NO: 386 | FLLTRILTI |
| SEQ ID NO: 387 | ITDQVPFSV |
| SEQ ID NO: 388 | YMCSFLFNL |
| SEQ ID NO: 389 | ILSLELMKL |
| SEQ ID NO: 390 | YLEYRQVPV |
| SEQ ID NO: 391 | RLPLVLPAV |
| SEQ ID NO: 392 | KLQVFLIVL |
| SEQ ID NO: 393 | YLGSYGFRL |

Example 14—Affinity Enhancement of Select Rabbit Antibodies

The rabbit antibody designated M0763 was used to generate numerous affinity matured variants, with substitutions within select CDR regions. CDRL1 (TADTLSRSYAS, SEQ ID NO: 472), CDRL2 (RDTSRPS, SEQ ID NO: 473), and CDRH1 (SNYAMS, SEQ ID NO: 469) were unaltered, with substitutions in CDRL3, CDRH2, and CDRH3 only.

Based on a humanized version of the M0763 antibody, affinity enhanced variants were identified from the humanized antibody library. Briefly, multiple antibody libraries were designed to span the entire length of all 6 CDRs randomizing 3 consecutive amino acids at the time. The libraries were generated using primers for site saturation mutagenesis. Therefore, the three amino acid positions targeted for randomization contained one of 19 possible amino acid variations. After electroporation into E. coli TG-1 cells, the diversity of the libraries was estimated by plating the libraries on agar plates using serial dilutions of the transfected TG-1 cells. The number of colonies growing on the plates was used as indication of library diversity assuming one inserted plasmid in each E. coli colony. Additionally, library quality was evaluated by sequencing a sample of approx. 10 clones per library.

Libraries comprising site saturation mutagenesis in the light chain were combined into one library and libraries comprising site saturation mutagenesis in the heavy chain were combined into another library. The two resulting libraries for randomized CDRs in light and heavy chains were subjected to affinity selection, henceforth referred as biopanning against the human recombinantly produced MAGE-A4/HLA-A02 complex protein. The MAGE-A4/HLA-A02 specific phage libraries are submitted to panning (selection) on antigen adsorbed on to polystyrene tubes or plates. Alternatively, the panning can be performed in solution using soluble biotinylated antigen. Several rounds of selection typically between two and five rounds can be performed until the antibodies with the desired specificity are obtained. The stringency of the biopanning conditions can be adjusted, particularly during later rounds of selection, for example by reducing the density of antigen coated to solid phase or increasing the amount of washing steps. To avoid non-specific binding of phage to surfaces, PBS supplemented with 2% skim milk and 0.05% Tween20 can be used as a blocking agent.

The selected phage antibody clones were grown up in 96-well plates and assayed for the ability to bind specifically MAGE-A4/HLA-A02 complex protein by ELISA. In order to evaluate specificity of the phage antibody clones, counter screening on HLA-A02 in complex with unrelated peptides was performed by ELISA. Phage antibody clones were then categorized into high, medium and low signal in ELISA for the target complex protein and for the HLA-A02 in complex with unrelated peptides. Clones with high binding signal for the target complex and low binding to the unrelated peptide-HLA-A02 complexes were sequenced. Sequence analysis facilitated the identification of unique clones which were then selected to expressed recombinantly in bispecific format anti-CD3 FAB×anti-MAGE-A4 scFv. The resulting constructs were then evaluated in SPR for binding affinity to MAGE-A4/HLA-A02 complex (Table 10). Affinity matured clones resulted in binding affinities as low as two-digit picomolar which is almost 1000-fold improved binding affinity compared to the parental M0763 antibody.

The amino acid sequences of the variant VH and VL domains are recited below:

| VH Amino Acid Sequence | SEQ ID NO: |
|---|---|
| >M1036_variable heavy chain<br>ESQVLESGGGSVQPGGSLRLSCTVSGFSLSNYAMSWVRQAPGKGLEYIGIVSS<br>GGTTYYASWAKGRFTISKDTSKNTVYLQMNSLRAEDTASYYCAKDLYYGPT<br>TQSAFNLWGQGTSVTVSS | 511 |
| >M1037_variable heavy chain<br>ESQVLESGGGSVQPGGSLRLSCTVSGFSLSNYAMSWVRQAPGKGLEYIGIVSS<br>GGTTYYASWAKGRFTISKDTSKNTVYLQMNSLRAEDTASYYCAKDLYYGPT<br>TYHDLNLWGQGTSVTVSS | 512 |

```
>M1038_variable heavy chain                                              513
ESQVLESGGGSVQPGGSLRLSCTVSGFSLSNYAMSWVRQAPGKGLEYIGIVSS
GGTTYYASWAKGRFTISKDTSKNTVYLQMNSLRAEDTASYYCAKNVYYGPT
TYSAFNLWGQGTSVTVSS >M1040_variable heavy chain                                              514
ESQVLESGGGSVQPGGSLRLSCTVSGFSLSNYAMSWVRQAPGKGLEYIGIVSS
GGTTYYASWAKGRFTISKDTSKNTVYLQMNSLRAEDTASYYCAKDLYYGPT
TYHQLNLWGQGTSVTVSS >M1041_variable heavy chain                                              515
ESQVLESGGGSVQPGGSLRLSCTVSGFSLSNYAMSWVRQAPGKGLEYIGIVSS
GGTTYYASWAKGRFTISKDTSKNTVYLQMNSLRAEDTASYYCAKDLYYGPT
TYSAFNLWGQGTSVTVSS >M1051_variable heavy chain                                              516
ESQVLESGGGSVQPGGSLRLSCTVSGFSLSNYAMSWVRQAPGKGLEYIGIVSS
GGRKRYASWAKGRFTISKDTSKNTVYLQMNSLRAEDTASYYCAKDLYYGPT
TYSAFNLWGQGTSVTVSS >M1086_variable heavy chain                                              517
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1087_variable heavy chain                                              518
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1088_variable heavy chain                                              519
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1089_variable heavy chain                                              520
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1090_variable heavy chain                                              521
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1096_variable heavy chain                                              522
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTQSAFNLWGQGTSVTVSS >M1097_variable heavy chain                                              523
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKNVYYGP
TTYSAFNLWGQGTSVTVSS >M1098_variable heavy chain                                              524
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKNVYYGP
TTQSAFNLWGQGTSVTVSS >M1099_variable heavy chain                                              525
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKNVYYGP
TTQSAFNLWGQGTSVTVSS >M1100_variable heavy chain                                              526
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYHDLNLWGQGTSVTVSS >M1101_variable heavy chain                                              527
EVQLLESGGGSVQPGGSLRLSCTVSGFSLSNYAMSWVRQAPGKGLEWIGIVS
SGGRKRYASWAKGRFTISKDTSKNTVYLQMNSLRAEDTASYYCAKDLYYGP
TTYSAFNLWGQGTSVTVSS >M1105_variable heavy chain                                              528
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKALYYGP
TTYSAFNLWGQGTSVTVSS
```

-continued

```
>M1107_variable heavy chain                              529
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLAYGP
TTYSAFNLWGQGTSVTVSS >M1108_variable heavy chain                              530
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYAGP
TTYSAFNLWGQGTSVTVSS >M1109_variable heavy chain                              531
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYAP
TTYSAFNLWGQGTSVTVSS >M1110_variable heavy chain                              532
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGA
TTYSAFNLWGQGTSVTVSS >M1111_variable heavy chain                              533
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
ATYSAFNLWGQGTSVTVSS >M1112_variable heavy chain                              534
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TAYSAFNLWGQGTSVTVSS >M1113_variable heavy chain                              535
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTASAFNLWGQGTSVTVSS >M1114_variable heavy chain                              536
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYAAFNLWGQGTSVTVSS >M1115_variable heavy chain                              537
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSSFNLWGQGTSVTVSS >M1116_variable heavy chain                              538
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAANLWGQGTSVTVSS >M1117_variable heavy chain                              539
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFALWGQGTSVTVSS >M1119_variable heavy chain                              540
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1120_variable heavy chain                              541
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1121_variable heavy chain                              542
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1122_variable heavy chain                              543
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS
```

-continued

```
>M1089_variable heavy chain                                              544
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1123_variable heavy chain                                              545
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1124_variable heavy chain                                              546
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1125_variable heavy chain                                              547
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1127_variable heavy chain                                              548
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1128_variable heavy chain                                              549
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1129_variable heavy chain                                              550
EVQLLESGGGSVQPGGSLRLSCTVSGFSLSNYAMSWVRQAPGKGLEWIGIVS
SGGTTYYASWAKGRFTISKDTSKNTVYLQMNSLRAEDTASYYCAKDLYYGP
TTYSAFNLWGQGTSVTVSS >M1130_variable heavy chain                                              551
EVQLLESGGGSVQPGGSLRLSCTVSGFSLSNYAMSWVRQAPGKGLEWIGAVS
SGGTTYYASWAKGRFTISKDTSKNTVYLQMNSLRAEDTASYYCAKDLYYGP
TTYSAFNLWGQGTSVTVSS >M1131_variable heavy chain                                              552
EVQLLESGGGSVQPGGSLRLSCTVSGFSLSNYAMSWVRQAPGKGLEWIGIAS
SGGTTYYASWAKGRFTISKDTSKNTVYLQMNSLRAEDTASYYCAKDLYYGP
TTYSAFNLWGQGTSVTVSS >M1132_variable heavy chain                                              553
EVQLLESGGGSVQPGGSLRLSCTVSGFSLSNYAMSWVRQAPGKGLEWIGIVA
SGGTTYYASWAKGRFTISKDTSKNTVYLQMNSLRAEDTASYYCAKDLYYGP
TTYSAFNLWGQGTSVTVSS >M1133_variable heavy chain                                              554
EVQLLESGGGSVQPGGSLRLSCTVSGFSLSNYAMSWVRQAPGKGLEWIGIVS
AGGTTYYASWAKGRFTISKDTSKNTVYLQMNSLRAEDTASYYCAKDLYYGP
TTYSAFNLWGQGTSVTVSS >M1134_variable heavy chain                                              555
EVQLLESGGGSVQPGGSLRLSCTVSGFSLSNYAMSWVRQAPGKGLEWIGIVS
SAGTTYYASWAKGRFTISKDTSKNTVYLQMNSLRAEDTASYYCAKDLYYGP
TTYSAFNLWGQGTSVTVSS >M1135_variable heavy chain                                              556
EVQLLESGGGSVQPGGSLRLSCTVSGFSLSNYAMSWVRQAPGKGLEWIGIVS
SGATTYYASWAKGRFTISKDTSKNTVYLQMNSLRAEDTASYYCAKDLYYGP
TTYSAFNLWGQGTSVTVSS >M1136_variable heavy chain                                              557
EVQLLESGGGSVQPGGSLRLSCTVSGFSLSNYAMSWVRQAPGKGLEWIGIVS
SGGATYYASWAKGRFTISKDTSKNTVYLQMNSLRAEDTASYYCAKDLYYGP
TTYSAFNLWGQGTSVTVSS >M1137_variable heavy chain                                              558
EVQLLESGGGSVQPGGSLRLSCTVSGFSLSNYAMSWVRQAPGKGLEWIGIVS
SGGTAYYASWAKGRFTISKDTSKNTVYLQMNSLRAEDTASYYCAKDLYYGP
TTYSAFNLWGQGTSVTVSS >M1138_variable heavy chain                                              559
EVQLLESGGGSVQPGGSLRLSCTVSGFSLSNYAMSWVRQAPGKGLEWIGIVS
SGGTTAYASWAKGRFTISKDTSKNTVYLQMNSLRAEDTASYYCAKDLYYGP
TTYSAFNLWGQGTSVTVSS
```

-continued

```
>M1139_variable heavy chain                                    560
EVQLLESGGGSVQPGGSLRLSCTVSGFSLSNYAMSWVRQAPGKGLEWIGIVS
SGGTTYYAASWAKGRFTISKDTSKNTVYLQMNSLRAEDTASYYCAKDLYYGP
TTYSAFNLWGQGTSVTVSS >M1140_variable heavy chain                                    561
EVQLLESGGGSVQPGGSLRLSCTVSGFSLSNYAMSWVRQAPGKGLEWIGIVS
SGGTTYYYSSWAKGRFTISKDTSKNTVYLQMNSLRAEDTASYYCAKDLYYGP
TTYSAFNLWGQGTSVTVSS >M1141_variable heavy chain                                    562
EVQLLESGGGSVQPGGSLRLSCTVSGFSLSNYAMSWVRQAPGKGLEWIGIVS
SGGTTYYYAAWAKGRFTISKDTSKNTVYLQMNSLRAEDTASYYCAKDLYYGP
TTYSAFNLWGQGTSVTVSS >M1142_variable heavy chain                                    563
EVQLLESGGGSVQPGGSLRLSCTVSGFSLSNYAMSWVRQAPGKGLEWIGIVS
SGGTTYYYASAAKGRFTISKDTSKNTVYLQMNSLRAEDTASYYCAKDLYYGP
TTYSAFNLWGQGTSVTVSS >M1143_variable heavy chain                                    564
EVQLLESGGGSVQPGGSLRLSCTVSGFSLSNYAMSWVRQAPGKGLEWIGIVS
SGGTTYYYASWSKGRFTISKDTSKNTVYLQMNSLRAEDTASYYCAKDLYYGP
TTYSAFNLWGQGTSVTVSS >M1144_variable heavy chain                                    565
EVQLLESGGGSVQPGGSLRLSCTVSGFSLSNYAMSWVRQAPGKGLEWIGIVS
SGGTTYYYASWAAGRFTISKDTSKNTVYLQMNSLRAEDTASYYCAKDLYYGP
TTYSAFNLWGQGTSVTVSS >M1145_variable heavy chain                                    566
EVQLLESGGGSVQPGGSLRLSCTVSGFSLSNYAMSWVRQAPGKGLEWIGIVS
SGGTTYYYASWAKARFTISKDTSKNTVYLQMNSLRAEDTASYYCAKDLYYGP
TTYSAFNLWGQGTSVTVSS >M1169_variable heavy chain                                    567
EVQLLESGGGSVQPGGSLRLSCTVSGFSLSNYAMSWVRQAPGKGLEWIGIVS
SGGTTYYYASWAKGRFTISKDTSKNTVYLQMNSLRAEDTASYYCAKDLYYGP
TTYSAANLWGQGTSVTVSS >M1171_variable heavy chain                                    568
EVQLLESGGGSVQPGGSLRLSCTVSGFSLSNYAMSWVRQAPGKGLEWIGIVS
SGGTTYYYASWAKGRFTISKDTSKNTVYLQMNSLRAEDTASYYCAKDLYYGP
TTYSALNLWGQGTSVTVSS >M1172_variable heavy chain                                    569
EVQLLESGGGSVQPGGSLRLSCTVSGFSLSNYAMSWVRQAPGKGLEWIGIVS
SGGTTYYYASWAKGRFTISKDTSKNTVYLQMNSLRAEDTASYYCAKDLYYGP
TTYSAPNLWGQGTSVTVSS >M1176_variable heavy chain                                    570
EVQLLESGGGSVQPGGSLRLSCTVSGFSLSNYAMSWVRQAPGKGLEWIGIVS
SGGTTYYYASWAKGRFTISKDTSKNTVYLQMNSLRAEDTASYYCAKDLYYGP
TTYSAANLWGQGTSVTVSS >M1177_variable heavy chain                                    571
EVQLLESGGGSVQPGGSLRLSCTVSGFSLSNYAMSWVRQAPGKGLEWIGIVS
SGGTTYYYASWAKGRFTISKDTSKNTVYLQMNSLRAEDTASYYCAKDLYYGP
TTYSAANLWGQGTSVTVSS >M1178_variable heavy chain                                    572
EVQLLESGGGSVQPGGSLRLSCTVSGFSLSNYAMSWVRQAPGKGLEWIGIVS
SGGTTYYYASWAKGRFTISKDTSKNTVYLQMNSLRAEDTASYYCAKDLYYGP
TTYSAANLWGQGTSVTVSS >M1202_variable heavy chain                                    573
EVQLLESGGGSVQPGGSLRLSCTVSGFSLSNYAMSWVRQAPGKGLEWIGIVS
SGGTTYYYASWAKGRFTISKDTSKNTVYLQMNSLRAEDTASYYCAKDLYYGP
TTYSSANLWGQGTSVTVSS >M1253_variable heavy chain                                    574
EVQLLESGGGSVQPGGSLRLSCTVSGFSLSNYAMSWVRQAPGKGLEWIGIVS
SGGTTYYYASWAKGRFTISKDTSKNTVYLQMNSLRAEDTASYYCAKDLYYGP
TTYSAANLWGQGTSVTVSS
```

| | SEQ ID NO: |
|---|---|
| >M1297_variable heavy chain<br>EVQLLESGGGSVQPGGSLRLSCTVSGFSLSNYAMSWVRQAPGKGLEWIGIVS<br>SGGTTYYASWAKGRFTISKDTSKNTVYLQMNSLRAEDTASYYCAKDLYYGP<br>STYFVANLWGQGTSVTVSS | 575 |
| >M1298_variable heavy chain<br>EVQLLESGGGSVQPGGSLRLSCTVSGFSLSNYAMSWVRQAPGKGLEWIGIVS<br>SGGTTYYASWAKGRFTISKDTSKNTVYLQMNSLRAEDTASYYCAKDLYYGP<br>TTYSAANLWGQGTSVTVSS | 576 |
| >M1299_variable heavy chain<br>EVQLLESGGGSVQPGGSLRLSCTVSGFSLSNYAMSWVRQAPGKGLEWIGIVS<br>SGGTTYYASWAKGRFTISKDTSKNTVYLQMNSLRAEDTASYYCAKDLYYGP<br>TTYSAANLWGQGTSVTVSS | 577 |
| >M1300_variable heavy chain<br>EVQLLESGGGSVQPGGSLRLSCTVSGFSLSNYAMSWVRQAPGKGLEWIGIVS<br>SGGTTYYASWAKGRFTISKDTSKNTVYLQMNSLRAEDTASYYCAKDLYYGP<br>TTYSAANLWGQGTSVTVSS | 578 |
| >M1301_variable heavy chain<br>EVQLLESGGGSVQPGGSLRLSCTVSGFSLSNYAMSWVRQAPGKGLEWIGIVS<br>SGGTTYYASWAKGRFTISKDTSKNTVYLQMNSLRAEDTASYYCAKDLYYGP<br>TTYSAANLWGQGTSVTVSS | 579 |
| >M1302_variable heavy chain<br>EVQLLESGGGSVQPGGSLRLSCTVSGFSLSNYAMSWVRQAPGKGLEWIGIVS<br>SGGTTYYASWAKGRFTISKDTSKNTVYLQMNSLRAEDTASYYCAKDLYYGP<br>NTDYSAANLWGQGTSVTVSS | 580 |
| >M1309_variable heavy chain<br>EVQLLESGGGSVQPGGSLRLSCTVSGFSLSNYAMSWVRQAPGKGLEWIGIVS<br>SGGTTYYASWAKGRFTISKDTSKNTVYLQMNSLRAEDTASYYCAKDLYYGP<br>STYFVANLWGQGTSVTVSS | 581 |
| >M1310_variable heavy chain<br>EVQLLESGGGSVQPGGSLRLSCTVSGFSLSNYAMSWVRQAPGKGLEWIGIVS<br>SGGTTYYASWAKGRFTISKDTSKNTVYLQMNSLRAEDTASYYCAKDLYYGP<br>NTDYSAANLWGQGTSVTVSS | 582 |
| >M1335_variable heavy chain<br>EVQLLESGGGSVQPGGSLRLSCTVSGFSLSNYAMSWVRQAPGKGLEWIGIVS<br>SGGTTYYADSVKGRFTISKDTSKNTVYLQMNSLRAEDTASYYCAKDLYYGPS<br>TYFVANLWGQGTSVTVSS | 583 |
| >M1342_variable heavy chain<br>EVQLLESGGGSVQPGGSLRLSCTVSGFSLSNYAMSWVRQAPGKGLEWIGIVS<br>SGGTTYYADSVKGRFTISKDTSKNTVYLQMNSLRAEDTASYYCAKDLYYGP<br>NTDYSAANLWGQGTSVTVSS | 584 |

| CDRH2 Amino Acid Sequence | SEQ ID NO: | CDRH3 Amino Acid Sequence | SEQ ID NO: |
|---|---|---|---|
| >M1036_CDRH2<br>IVSSGGTTYYASWAKG | 585 | >M1036_CDRH3<br>DLYYGPTTQSAFNL | 659 |
| >M1037_CDRH2<br>IVSSGGTTYYASWAKG | 586 | >M1037_CDRH3<br>DLYYGPTTYHDLNL | 660 |
| >M1038_CDRH2<br>IVSSGGTTYYASWAKG | 587 | >M1038_CDRH3<br>NVYYGPTTYSAFNL | 661 |
| >M1040_CDRH2<br>IVSSGGTTYYASWAKG | 588 | >M1040_CDRH3<br>DLYYGPTTYHQLNL | 662 |
| >M1041_CDRH2<br>IVSSGGTTYYASWAKG | 589 | >M1041_CDRH3<br>DLYYGPTTYSAFNL | 663 |
| >M1051_CDRH2<br>IVSSGGRKRYASWAKG | 590 | >M1051_CDRH3<br>DLYYGPTTYSAFNL | 664 |
| >M1086_CDRH2<br>IVSSGGTTYYASWAKG | 591 | >M1086_CDRH3<br>DLYYGPTTYSAFNL | 665 |
| >M1087_CDRH2<br>IVSSGGTTYYASWAKG | 592 | >M1087_CDRH3<br>DLYYGPTTYSAFNL | 666 |
| >M1088_CDRH2<br>IVSSGGTTYYASWAKG | 593 | >M1088_CDRH3<br>DLYYGPTTYSAFNL | 667 |

-continued

| | | | |
|---|---|---|---|
| >M1089_CDRH2<br>IVSSGGTTYYASWAKG | 594 | >M1089_CDRH3<br>DLYYGPTTYSAFNL | 668 |
| >M1090_CDRH2<br>IVSSGGTTYYASWAKG | 595 | >M1090_CDRH3<br>DLYYGPTTYSAFNL | 669 |
| >M1096_CDRH2<br>IVSSGGTTYYASWAKG | 596 | >M1096_CDRH3<br>DLYYGPTTQSAFNL | 670 |
| >M1097_CDRH2<br>IVSSGGTTYYASWAKG | 597 | >M1097_CDRH3<br>NVYYGPTTYSAFNL | 671 |
| >M1098_CDRH2<br>IVSSGGTTYYASWAKG | 598 | >M1098_CDRH3<br>NVYYGPTTQSAFNL | 672 |
| >M1099_CDRH2<br>IVSSGGTTYYASWAKG | 599 | >M1099_CDRH3<br>NVYYGPTTQSAFNL | 673 |
| >M1100_CDRH2<br>IVSSGGTTYYASWAKG | 600 | >M1100_CDRH3<br>DLYYGPTTYHDLNL | 674 |
| >M1101_CDRH2<br>IVSSGGRKRYASWAKG | 601 | >M1101_CDRH3<br>DLYYGPTTYSAFNL | 675 |
| >M1105_CDRH2<br>IVSSGGTTYYASWAKG | 602 | >M1105_CDRH3<br>ALYYGPTTYSAFNL | 676 |
| >M1107_CDRH2<br>IVSSGGTTYYASWAKG | 603 | >M1107_CDRH3<br>DLAYGPTTYSAFNL | 677 |
| >M1108_CDRH2<br>IVSSGGTTYYASWAKG | 604 | >M1108_CDRH3<br>DLYAGPTTYSAFNL | 678 |
| >M1109_CDRH2<br>IVSSGGTTYYASWAKG | 605 | >M1109_CDRH3<br>DLYYAPTTYSAFNL | 679 |
| >M1110_CDRH2<br>IVSSGGTTYYASWAKG | 606 | >M1110_CDRH3<br>DLYYGATTYSAFNL | 680 |
| >M1111_CDRH2<br>IVSSGGTTYYASWAKG | 607 | >M1111_CDRH3<br>DLYYGPATYSAFNL | 681 |
| >M1112_CDRH2<br>IVSSGGTTYYASWAKG | 608 | >M1112_CDRH3<br>DLYYGPTAYSAFNL | 682 |
| >M1113_CDRH2<br>IVSSGGTTYYASWAKG | 609 | >M1113_CDRH3<br>DLYYGPTTASFNL | 683 |
| >M1114_CDRH2<br>IVSSGGTTYYASWAKG | 610 | >M1114_CDRH3<br>DLYYGPTTYAFNL | 684 |
| >M1115_CDRH2<br>IVSSGGTTYYASWAKG | 611 | >M1115_CDRH3<br>DLYYGPTTYSSFNL | 685 |
| >M1116_CDRH2<br>IVSSGGTTYYASWAKG | 612 | >M1116_CDRH3<br>DLYYGPTTYSAANL | 686 |
| >M1117_CDRH2<br>IVSSGGTTYYASWAKG | 613 | >M1117_CDRH3<br>DLYYGPTTYSAFAL | 687 |
| >M1119_CDRH2<br>IVSSGGTTYYASWAKG | 614 | >M1119_CDRH3<br>DLYYGPTTYSAFNL | 688 |
| >M1120_CDRH2<br>IVSSGGTTYYASWAKG | 615 | >M1120_CDRH3<br>DLYYGPTTYSAFNL | 689 |
| >M1121_CDRH2<br>IVSSGGTTYYASWAKG | 616 | >M1121_CDRH3<br>DLYYGPTTYSAFNL | 690 |
| >M1122_CDRH2<br>IVSSGGTTYYASWAKG | 617 | >M1122_CDRH3<br>DLYYGPTTYSAFNL | 691 |
| >M1089_CDRH2<br>IVSSGGTTYYASWAKG | 618 | >M1089_CDRH3<br>DLYYGPTTYSAFNL | 692 |
| >M1123_CDRH2<br>IVSSGGTTYYASWAKG | 619 | >M1123_CDRH3<br>DLYYGPTTYSAFNL | 693 |

-continued

| | | | |
|---|---|---|---|
| >M1124_CDRH2<br>IVSSGGTTYYASWAKG | 620 | >M1124_CDRH3<br>DLYYGPTTYSAFNL | 694 |
| >M1125_CDRH2<br>IVSSGGTTYYASWAKG | 621 | >M1125_CDRH3<br>DLYYGPTTYSAFNL | 695 |
| >M1127_CDRH2<br>IVSSGGTTYYASWAKG | 622 | >M1127_CDRH3<br>DLYYGPTTYSAFNL | 696 |
| >M1128_CDRH2<br>IVSSGGTTYYASWAKG | 623 | >M1128_CDRH3<br>DLYYGPTTYSAFNL | 697 |
| >M1129_CDRH2<br>IVSSGGTTYYASWAKG | 624 | >M1129_CDRH3<br>DLYYGPTTYSAFNL | 698 |
| >M1130_CDRH2<br>AVSSGGTTYYASWAKG | 625 | >M1130_CDRH3<br>DLYYGPTTYSAFNL | 699 |
| >M1131_CDRH2<br>IASSGGTTYYASWAKG | 626 | >M1131_CDRH3<br>DLYYGPTTYSAFNL | 700 |
| >M1132_CDRH2<br>IVASGGTTYYASWAKG | 627 | >M1132_CDRH3<br>DLYYGPTTYSAFNL | 701 |
| >M1133_CDRH2<br>IVSAGGTTYYASWAKG | 628 | >M1133_CDRH3<br>DLYYGPTTYSAFNL | 702 |
| >M1134_CDRH2<br>IVSSAGTTYYASWAKG | 629 | >M1134_CDRH3<br>DLYYGPTTYSAFNL | 703 |
| >M1135_CDRH2<br>IVSSGATTYYASWAKG | 630 | >M1135_CDRH3<br>DLYYGPTTYSAFNL | 704 |
| >M1136_CDRH2<br>IVSSGGATYYASWAKG | 631 | >M1136_CDRH3<br>DLYYGPTTYSAFNL | 705 |
| >M1137_CDRH2<br>IVSSGGTAYYASWAKG | 632 | >M1137_CDRH3<br>DLYYGPTTYSAFNL | 706 |
| >M1138_CDRH2<br>IVSSGGTTAYASWAKG | 633 | >M1138_CDRH3<br>DLYYGPTTYSAFNL | 707 |
| >M1139_CDRH2<br>IVSSGGTTYAASWAKG | 634 | >M1139_CDRH3<br>DLYYGPTTYSAFNL | 708 |
| >M1140_CDRH2<br>IVSSGGTTYYSSWAKG | 635 | >M1140_CDRH3<br>DLYYGPTTYSAFNL | 709 |
| >M1141_CDRH2<br>IVSSGGTTYYAAWAKG | 636 | >M1141_CDRH3<br>DLYYGPTTYSAFNL | 710 |
| >M1142_CDRH2<br>IVSSGGTTYYASAAKG | 637 | >M1142_CDRH3<br>DLYYGPTTYSAFNL | 711 |
| >M1143_CDRH2<br>IVSSGGTTYYASWSKG | 638 | >M1143_CDRH3<br>DLYYGPTTYSAFNL | 712 |
| >M1144_CDRH2<br>IVSSGGTTYYASWAAG | 639 | >M1144_CDRH3<br>DLYYGPTTYSAFNL | 713 |
| >M1145_CDRH2<br>IVSSGGTTYYASWAKA | 640 | >M1145_CDRH3<br>DLYYGPTTYSAFNL | 714 |
| >M1169_CDRH2<br>IVSSGGTTYYASWAKG | 641 | >M1169_CDRH3<br>DLYYGPTTYSAANL | 715 |
| >M1171_CDRH2<br>IVSSGGTTYYASWAKG | 642 | >M1171_CDRH3<br>DLYYGPTTYSALNL | 716 |
| >M1172_CDRH2<br>IVSSGGTTYYASWAKG | 643 | >M1172_CDRH3<br>DLYYGPTTYSAFNL | 717 |
| >M1176_CDRH2<br>IVSSGGTTYYASWAKG | 644 | >M1176_CDRH3<br>DLYYGPTTYSAANL | 718 |
| >M1177_CDRH2<br>IVSSGGTTYYASWAKG | 645 | >M1177_CDRH3<br>DLYYGPTTYSAANL | 719 |

| | | | |
|---|---|---|---|
| >M1178_CDRH2<br>IVSSGGTTYYASWAKG | 646 | >M1178_CDRH3<br>DLYYGPTTYSAANL | 720 |
| >M1202_CDRH2<br>IVSSGGTTYYASWAKG | 647 | >M1202_CDRH3<br>DLYYGPTTYSSANL | 721 |
| >M1253_CDRH2<br>IVSSGGTTYYASWAKG | 648 | >M1253_CDRH3<br>DLYYGPTTYSAANL | 722 |
| >M1297_CDRH2<br>IVSSGGTTYYASWAKG | 649 | >M1297_CDRH3<br>DLYYGPSTYFVANL | 723 |
| >M1298_CDRH2<br>IVSSGGTTYYASWAKG | 650 | >M1298_CDRH3<br>DLYYGPTTYSAANL | 724 |
| >M1299_CDRH2<br>IVSSGGTTYYASWAKG | 651 | >M1299_CDRH3<br>DLYYGPTTYSAANL | 725 |
| >M1300_CDRH2<br>IVSSGGTTYYASWAKG | 652 | >M1300_CDRH3<br>DLYYGPTTYSAANL | 726 |
| >M1301_CDRH2<br>IVSSGGTTYYASWAKG | 886 | >M1301_CDRH3<br>DLYYGPTTYSAANL | 727 |
| >M1302_CDRH2<br>IVSSGGTTYYASWAKG | 654 | >M1302_CDRH3<br>DLYYGPNTDYSAANL | 728 |
| >M1309_CDRH2<br>IVSSGGTTYYASWAKG | 655 | >M1309_CDRH3<br>DLYYGPSTYFVANL | 729 |
| >M1310_CDRH2<br>IVSSGGTTYYASWAKG | 656 | >M1310_CDRH3<br>DLYYGPNTDYSAANL | 730 |
| >M1335_CDRH2<br>IVSSGGTTYYADVSKG | 887 | >M1335_CDRH3<br>DLYYGPSTYFVANL | 731 |
| >M1342_CDRH2<br>IVSSGGTTYYADSVKG | 658 | >M1342_CDRH3<br>DLYYGPNTDYSAANL | 732 |

| VL Amino Acid Sequence | SEQ ID NO: |
|---|---|
| >M1036_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATSDGSGSNFQLFGGGTKL<br>TVL | 733 |
| >M1037_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATSDGSGSNFQLFGGGTKL<br>TVL | 734 |
| >M1038_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATSDGSGSNFQLFGGGTKL<br>TVL | 735 |
| >M1040_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATSDGSGSNFQLFGGGTKL<br>TVL | 736 |
| >M1041_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQLFGGGTKL<br>TVL | 737 |
| >M1051_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATSDGSGSNFQLFGGGTKL<br>TVL | 738 |
| >M1086_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATSPSSGSNFQLFGGGTKL<br>TVL | 739 |

```
>M1087_variable light chain                                          740
SYELTQPPSVSVSPGQTASITCTADTLSRSYASWYQQKPGQSPVLVIYRDTSR
PSGIPERFSGSNSGNTATLTISGTQAMDEADYYCATRDSSGSNFQLFGGGTKL
TVL >M1088_variable light chain                                          741
SYELTQPPSVSVSPGQTASITCTADTLSRSYASWYQQKPGQSPVLVIYRDTSR
PSGIPERFSGSNSGNTATLTISGTQAMDEADYYCATRPGSGSNFQLFGGGTKL
TVL >M1089_variable light chain                                          742
SYELTQPPSVSVSPGQTASITCTADTLSRSYASWYQQKPGQSPVLVIYRDTSR
PSGIPERFSGSNSGNTATLTISGTQAMDEADYYCATRPASGSNFQLFGGGTKL
TVL >M1090_variable light chain                                          743
SYELTQPPSVSVSPGQTASITCTADTLSRSYASWYQQKPGQSPVLVIYRDTSR
PSGIPERFSGSNSGNTATLTISGTQAMDEADYYCATKPSSGSNFQLFGGGTKL
TVL >M1096_variable light chain                                          744
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1097_variable light chain                                          745
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1098_variable light chain                                          746
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1099_variable light chain                                          747
SYELTQPPSVSVSPGQTASITCTADTLSRSYASWYQQKPGQSPVLVIYRDTSR
PSGIPERFSGSNSGNTATLTISGTQAMDEADYYCATSDGSGSNFQLFGGGTKL
TVL >M1100 variable light chain                                          748
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1101 variable light chain                                          749
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1105_variable light chain                                          750
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1107_variable light chain                                          751
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1108_variable light chain                                          752
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1109_variable light chain                                          753
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1110_variable light chain                                          754
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1111_variable light chain                                          755
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL
```

```
>M1112_variable light chain                                          756
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1113_variable light chain                                          757
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1114_variable light chain                                          758
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1115_variable light chain                                          759
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1116_variable light chain                                          760
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1117_variable light chain                                          761
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1119_variable light chain                                          762
SYELTQPPSVSVSPGQTASITCTADTLSRSYASWYQQKPGQSPVLVIYRDTSR
PSGIPERFSGSNSGNTATLTISGTQAMDEADYYCSTRPSSGSNFQLFGGGTKLT
VL >M1120_variable light chain                                          763
SYELTQPPSVSVSPGQTASITCTADTLSRSYASWYQQKPGQSPVLVIYRDTSR
PSGIPERFSGSNSGNTATLTISGTQAMDEADYYCAARPSSGSNFQLFGGGTKL
TVL >M1121_variable light chain                                          764
SYELTQPPSVSVSPGQTASITCTADTLSRSYASWYQQKPGQSPVLVIYRDTSR
PSGIPERFSGSNSGNTATLTISGTQAMDEADYYCATAPSSGSNFQLFGGGTKL
TVL >M1122_variable light chain                                          765
SYELTQPPSVSVSPGQTASITCTADTLSRSYASWYQQKPGQSPVLVIYRDTSR
PSGIPERFSGSNSGNTATLTISGTQAMDEADYYCATRASSGSNFQLFGGGTKL
TVL >M1089_variable light chain                                          766
SYELTQPPSVSVSPGQTASITCTADTLSRSYASWYQQKPGQSPVLVIYRDTSR
PSGIPERFSGSNSGNTATLTISGTQAMDEADYYCATRPASGSNFQLFGGGTKL
TVL >M1123_variable light chain                                          767
SYELTQPPSVSVSPGQTASITCTADTLSRSYASWYQQKPGQSPVLVIYRDTSR
PSGIPERFSGSNSGNTATLTISGTQAMDEADYYCATRPSAGSNFQLFGGGTKL
TVL >M1124_variable light chain                                          768
SYELTQPPSVSVSPGQTASITCTADTLSRSYASWYQQKPGQSPVLVIYRDTSR
PSGIPERFSGSNSGNTATLTISGTQAMDEADYYCATRPSSASNFQLFGGGTKL
TVL >M1125_variable light chain                                          769
SYELTQPPSVSVSPGQTASITCTADTLSRSYASWYQQKPGQSPVLVIYRDTSR
PSGIPERFSGSNSGNTATLTISGTQAMDEADYYCATRPSSGANFQLFGGGTKL
TVL >M1127_variable light chain                                          770
SYELTQPPSVSVSPGQTASITCTADTLSRSYASWYQQKPGQSPVLVIYRDTSR
PSGIPERFSGSNSGNTATLTISGTQAMDEADYYCATRPSSGSNAQLFGGGTKL
TVL
```

```
>M1128_variable light chain                                      771
SYELTQPPSVSVSPGQTASITCTADTLSRSYASWYQQKPGQSPVLVIYRDTSR
PSGIPERFSGSNSGNTATLTISGTQAMDEADYYCATRPSSGSNFALFGGGTKL
TVL >M1129_variable light chain                                      772
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQAFGGGTKL
TVL >M1130_variable light chain                                      773
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1131_variable light chain                                      774
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1132_variable light chain                                      775
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1133_variable light chain                                      776
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1134_variable light chain                                      777
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1135_variable light chain                                      778
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1136_variable light chain                                      779
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1137_variable light chain                                      780
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1138_variable light chain                                      781
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1139_variable light chain                                      782
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1140_variable light chain                                      783
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1141_variable light chain                                      784
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1142_variable light chain                                      785
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL >M1143_variable light chain                                      786
SYELTQPPSVSVSPGQTASITCTADTLSRSYASWYQQKPGQSPVLVIYRDTSR
PSGIPERFSGSNSGNTATLTISGTQAMDEADYYCATRPSSGSNFQLFGGGTKL
TVL
```

| | |
|---|---|
| >M1144_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQLFGGGTKL<br>TVL | 787 |
| >M1145_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQLFGGGTKL<br>TVL | 788 |
| >M1169_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFVLFGGGTKL<br>TVL | 789 |
| >M1171_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQLFGGGTKL<br>TVL | 790 |
| >M1172_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQLFGGGTKL<br>TVL | 791 |
| >M1176_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSVFQLFGGGTKL<br>TVL | 792 |
| >M1177_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNTVVFGGGTKL<br>TVL | 793 |
| >M1178_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCQARPSSGSNFQLFGGGTKL<br>TVL | 794 |
| >M1202_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQLFGGGTKL<br>TVL | 795 |
| >M1253_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQAFGGGTKL<br>TVL | 796 |
| >M1297_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQLFGGGTKL<br>TVL | 797 |
| >M1298_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPWPGSNFQLFGGGTKL<br>TVL | 798 |
| >M1299_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPFPGSNFQLFGGGTKL<br>TVL | 799 |
| >M1300_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRLFSGSNFQLFGGGTKL<br>TVL | 800 |
| >M1301_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRDFSGSNFQLFGGGTKL<br>TVL | 801 |

-continued

| | SEQ ID NO: |
|---|---|
| >M1302_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQLFGGGTKL<br>TVL | 802 |
| >M1309_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQAFGGGTKL<br>TVL | 803 |
| >M1310_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQAFGGGTKL<br>TVL | 804 |
| >M1335_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQLFGGGTKL<br>TVL | 805 |
| >M1342_variable light chain<br>SYELTQPPSVSVSPGQTASITCTADTLSRSYASWYQQKPGQSPVLVIYRDTSR<br>PSGIPERFSGSNSGNTATLTISGTQAMDEADYYCATRPSSGSNFQAFGGGTKL<br>TVL | 806 |

| CDRL3 Amino Acid Sequence | SEQ ID NO: |
|---|---|
| >M1036_CDRL3<br>ATSDGSGSNFQL | 807 |
| >M1037_CDRL3<br>ATSDGSGSNFQL | 808 |
| >M1038_CDRL3<br>ATSDGSGSNFQL | 809 |
| >M1040_CDRL3<br>ATSDGSGSNFQL | 810 |
| >M1041_CDRL3<br>ATRPSSGSNFQL | 811 |
| >M1051_CDRL3<br>ATSDGSGSNFQL | 812 |
| >M1086_CDRL3<br>ATSPSSGSNFQL | 813 |
| >M1087_CDRL3<br>ATRDSSGSNFQL | 814 |
| >M1088_CDRL3<br>ATRPGSGSNFQL | 815 |
| >M1089_CDRL3<br>ATRPASGSNFQL | 816 |
| >M1090_CDRL3<br>ATKPSSGSNFQL | 817 |
| >M1096_CDRL3<br>ATRPSSGSNFQL | 818 |
| >M1097_CDRL3<br>ATRPSSGSNFQL | 819 |
| >M1098_CDRL3<br>ATRPSSGSNFQL | 820 |
| >M1099_CDRL3<br>ATSDGSGSNFQL | 821 |
| >M1100_CDRL3<br>ATRPSSGSNFQL | 822 |

```
>M1101_CDRL3                        823
ATRPSSGSNFQL

>M1105_CDRL3                        824
ATRPSSGSNFQL

>M1107_CDRL3                        825
ATRPSSGSNFQL

>M1108_CDRL3                        826
ATRPSSGSNFQL

>M1109_CDRL3                        827
ATRPSSGSNFQL

>M1110_CDRL3                        828
ATRPSSGSNFQL

>M1111_CDRL3                        829
ATRPSSGSNFQL

>M1112_CDRL3                        830
ATRPSSGSNFQL

>M1113_CDRL3                        831
ATRPSSGSNFQL

>M1114_CDRL3                        832
ATRPSSGSNFQL

>M1115_CDRL3                        833
ATRPSSGSNFQL

>M1116_CDRL3                        834
ATRPSSGSNFQL

>M1117_CDRL3                        835
ATRPSSGSNFQL

>M1119_CDRL3                        836
STRPSSGSNFQL

>M1120_CDRL3                        837
AARPSSGSNFQL

>M1121_CDRL3                        838
ATAPSSGSNFQL

>M1122_CDRL3                        839
ATRASSGSNFQL

>M1089_CDRL3                        840
ATRPASGSNFQL

>M1123_CDRL3                        841
ATRPSAGSNFQL

>M1124_CDRL3                        842
ATRPSSASNFQL

>M1125_CDRL3                        843
ATRPSSGANFQL

>M1127_CDRL3                        844
ATRPSSGSNAQL

>M1128_CDRL3                        845
ATRPSSGSNFAL

>M1129_CDRL3                        846
ATRPSSGSNFQA

>M1130_CDRL3                        847
ATRPSSGSNFQL
```

| | |
|---|---|
| >M1131_CDRL3<br>ATRPSSGSNFQL | 848 |
| >M1132_CDRL3<br>ATRPSSGSNFQL | 849 |
| >M1133_CDRL3<br>ATRPSSGSNFQL | 850 |
| >M1134_CDRL3<br>ATRPSSGSNFQL | 851 |
| >M1135_CDRL3<br>ATRPSSGSNFQL | 852 |
| >M1136_CDRL3<br>ATRPSSGSNFQL | 853 |
| >M1137_CDRL3<br>ATRPSSGSNFQL | 854 |
| >M1138_CDRL3<br>ATRPSSGSNFQL | 855 |
| >M1139_CDRL3<br>ATRPSSGSNFQL | 856 |
| >M1140_CDRL3<br>ATRPSSGSNFQL | 857 |
| >M1141_CDRL3<br>ATRPSSGSNFQL | 858 |
| >M1142_CDRL3<br>ATRPSSGSNFQL | 859 |
| >M1143_CDRL3<br>ATRPSSGSNFQL | 860 |
| >M1144_CDRL3<br>ATRPSSGSNFQL | 861 |
| >M1145_CDRL3<br>ATRPSSGSNFQL | 862 |
| >M1169_CDRL3<br>ATRPSSGSNFVL | 863 |
| >M1171_CDRL3<br>ATRPSSGSNFQL | 864 |
| >M1172_CDRL3<br>ATRPSSGSNFQL | 865 |
| >M1176_CDRL3<br>ATRPSSGSVFQL | 866 |
| >M1177_CDRL3<br>ATRPSSGSNTVV | 867 |
| >M1178_CDRL3<br>QARPSSGSNFQL | 868 |
| >M1202_CDRL3<br>ATRPSSGSNFQL | 869 |
| >M1253_CDRL3<br>ATRPSSGSNFQA | 870 |
| >M1297_CDRL3<br>ATRPSSGSNFQL | 871 |
| >M1298_CDRL3<br>ATRPWPGSNFQL | 872 |

-continued

| | |
|---|---|
| >M1299_CDRL3<br>ATRPFPGSNFQL | 873 |
| >M1300_CDRL3<br>ATRLFSGSNFQL | 874 |
| >M1301_CDRL3<br>ATRDFSGSNFQL | 875 |
| >M1302_CDRL3<br>ATRPSGSNFQL | 876 |
| >M1309_CDRL3<br>ATRPSSGSNFQA | 877 |
| >M1310_CDRL3<br>ATRPSSGSNFQA | 878 |
| >M1335_CDRL3<br>ATRPSSGSNFQL | 879 |
| >M1342_CDRL3<br>ATRPSSGSNFQA | 880 |

| SEQ ID NO: | Sequence |
|---|---|
| Consensus CDRH2<br>SEQ ID NO: 881 | IVSSGGTTYYAX$_1$X$_2$X$_3$KG, wherein X$_1$ corresponds to amino acid S or D, X$_2$ corresponds to amino acid W or S, and X$_3$ corresponds to amino acid A or V |
| Consensus CDRH3<br>SEQ ID NO: 882 | DLYYGPX$_4$TX$_5$YX$_6$X$_7$X$_8$NL, wherein X$_4$ corresponds to amino acid T, N, or S, X$_5$ corresponds to amino acid D or is absent, X$_6$ corresponds to amino acid S or F, X$_7$ corresponds to amino acid A or V, and X$_8$ corresponds to amino acid F or A |
| Consensus CDRL3<br>SEQ ID NO: 883 | ATX$_9$X$_{10}$X$_{11}$SGSNFQX$_{12}$, wherein X$_9$ corresponds to amino acid S or R, X$_{10}$ corresponds to amino acid D or P, X$_{11}$ corresponds to amino acid G, S, or F, and X$_{12}$ corresponds to amino acid L or A |

TABLE 10

Binding Affinity Values to MAGE-A4 pMHC for Variant Antibodies

| Monovalent | Affinity KD (nM) |
|---|---|
| M1036 | 4.90 |
| M1037 | 0.40 |
| M1038 | 3.60 |
| M1040 | 0.45 |
| M1041 | 0.24 |
| M1051 | 5.00 |
| M1086 | 7.02 |
| M1087 | 0.82 |
| M1088 | 3.90 |
| M1089 | 1.34 |
| M1090 | 1.80 |
| M1096 | 3.23 |
| M1097 | 0.99 |
| M1098 | 1.73 |
| M1099 | 2.13 |
| M1100 | 0.66 |
| M1101 | 1.69 |
| M1105 | 4.12 |
| M1107 | 1.45 |
| M1108 | 19.00 |
| M1109 | 11.70 |
| M1110 | 9.65 |
| M1111 | 0.65 |
| M1112 | 35.90 |
| M1113 | 15.30 |
| M1114 | 1.18 |
| M1115 | 0.48 |
| M1116 | 3.88 |
| M1117 | 4.20 |
| M1119 | 0.91 |
| M1120 | 1.21 |
| M1121 | 6.53 |
| M1122 | 0.75 |
| M1089 | 0.79 |
| M1123 | 0.79 |
| M1124 | 0.65 |
| M1125 | 0.89 |
| M1127 | 0.89 |
| M1128 | 1.32 |
| M1129 | 0.46 |
| M1130 | 2.20 |
| M1131 | 3.20 |
| M1132 | 4.10 |
| M1133 | 12.40 |
| M1134 | 4.20 |
| M1135 | 2.40 |
| M1136 | 2.70 |
| M1137 | 2.20 |
| M1138 | 3.10 |
| M1139 | 2.10 |

TABLE 10-continued

Binding Affinity Values to MAGE-A4 pMHC for Variant Antibodies

| Monovalent | Affinity KD (nM) |
| --- | --- |
| M1140 | 2.80 |
| M1141 | 1.20 |
| M1142 | 2.90 |
| M1143 | 2.40 |
| M1144 | 2.30 |
| M1145 | 2.10 |
| M1169 | 3.20 |
| M1171 | 4.40 |
| M1172 | 1.50 |
| M1176 | 6.00 |
| M1177 | 4.20 |
| M1178 | 8.30 |
| M1202 | 3.90 |
| M1253 | 2.55 |
| M1297 | 0.09 |
| M1298 | 0.07 |
| M1299 | 0.05 |
| M1300 | 0.12 |
| M1301 | 0.12 |
| M1302 | 0.60 |
| M1309 | 0.09 |
| M1310 | 0.35 |
| M763 | 44.00 |

Optimization of the Rarely Occurring Amino Acids at the CDR Regions

In an additional step, anti-MAGE-A4 antibodies were engineered to reduce the risk for immunogenicity. For this, CDR sequences of the anti-MAGE-A4 antibodies were examined for the presence of rarely occurring amino acid residues in the human repertoire. Unusual amino acid sequences in the CDR sequences were replaced by amino acid residues that frequently occur in databases of human antibodies (these residues may have lower risk of immunogenicity as they are naturally present in human antibodies). Germline analysis and frequency of occurrence of defined amino acids at relatively conserved positions revealed the presence of three amino acids in CDRH2 rarely occurring in the human antibody repertoire and therefore considered to have an increased risk factor for immunogenicity.

The relevant HCDR2 sequence is IVSSGGTTYYAS-WAKG (SEQ ID NO: 470). The underlined SWA motif present in the parental rabbit antibody M0763 was substituted by DSV which is a sequence stretch that frequently occurs in databases of human antibodies. While the biological relevance and potential impact of this motif on immunogenicity remains unclear, two variants devoid of the rare occurring motif SWA were generated by substituting SWA by DSV. The variants, designated M1335 and M1342, were further characterized in SPR and the effect of this replacement on binding affinity was considered not significant. The VH, VL, HCDR2, HCDR3, and LCDR3 amino acid sequences for variants M1335 and M1342 are recited above.

SEQUENCE LISTING (954 sequences)

SEQ ID NO: 1 - protein, 275 aa, Homo sapiens [sequence omitted]

SEQ ID NO: 2 - protein, 99 aa, Homo sapiens [sequence omitted]

SEQ ID NO: 3 - protein, 10 aa, Homo sapiens
GVYDGREHTV

SEQ ID NO: 4 - DNA, 17 bp, Artificial Sequence
  Description of Artificial Sequence: Synthetic primer
gctgacgatgctgccac

SEQ ID NO: 5 - DNA, 15 bp, Artificial Sequence
  Description of Artificial Sequence: Synthetic primer
gctgccgatgctgcc

SEQ ID NO: 6 - DNA, 16 bp, Artificial Sequence
  Description of Artificial Sequence: Synthetic primer
ctccacgccactgatg

SEQ ID NO: 7 - DNA, 17 bp, Artificial Sequence
  Description of Artificial Sequence: Synthetic primer
ctgtacgccactgatgg

SEQ ID NO: 8 - DNA, 16 bp, Artificial Sequence
  Description of Artificial Sequence: Synthetic primer
ctgcacaccgctgatg

SEQ ID NO: 9 - DNA, 13 bp, Artificial Sequence
  Description of Artificial Sequence: Synthetic primer
ctgcacgccgctg

SEQ ID NO: 10 - DNA, 16 bp, Artificial Sequence
  Description of Artificial Sequence: Synthetic primer
ctgcacgccactgatg

SEQ ID NO: 11 - DNA, 16 bp, Artificial Sequence
  Description of Artificial Sequence: Synthetic primer
ctgcacgccgttgatg

SEQ ID NO: 12 - DNA, 17 bp, Artificial Sequence
  Description of Artificial Sequence: Synthetic primer
ctccaggtcgctgatgg

SEQ ID NO: 13 - DNA, 16 bp, Artificial Sequence
  Description of Artificial Sequence: Synthetic primer
ctgtgcaccgctgatg

SEQ ID NO: 14 - DNA, 16 bp, Artificial Sequence
  Description of Artificial Sequence: Synthetic primer
ctgcacgtcgctgatg

SEQ ID NO: 15 - DNA, 17 bp, Artificial Sequence
  Description of Artificial Sequence: Synthetic primer
ctgcacaccactgatgg

SEQ ID NO: 16 - protein, 252 aa, Artificial Sequence
  Description of Artificial Sequence: Synthetic polypeptide
QEQLVESGGGLVTPGTPLTLTCTVSGFSLSSYAMGWVRQAPGKGLEWIGTINDGGTAFYASWVKGRFTISRTSTTVDLRVTSPTTEDTATYFCARAYGSNGDVYWGYFNLWGQGTLVTVSSGGGGSGGGGSGGGGSGGGGASELDLTQTPASVEVAVGGTVTIKCQASQSIGSYLSWYQQKPGQRPKLLIFRASTLASGVSSRFKGSGSGTQFTLTISGVECADAATYYCQQGYSSTNLDNVFGGGTEVVVK

SEQ ID NO: 17 - protein, 121 aa, Artificial Sequence
  Description of Artificial Sequence: Synthetic polypeptide
QEQLVESGGGLVTPGTPLTLTCTVSGFSLSSYAMGWVRQAPGKGLEWIGTINDGGTAFYASWVKGRFTISRTSTTVDLRVTSPTTEDTATYFCARAYGSNGDVYWGYFNLWGQGTLVTVSS

SEQ ID NO: 18 - protein, 110 aa, Artificial Sequence
  Description of Artificial Sequence: Synthetic polypeptide
ELDLTQTPASVEVAVGGTVTIKCQASQSIGSYLSWYQQKPGQRPKLLIFRASTLASGVSSRFKGSGSGTQFTLTISGVECADAATYYCQQGYSSTNLDNVFGGGTEVVVK

SEQ ID NO: 19 - protein, 6 aa, Artificial Sequence
  Description of Artificial Sequence: Synthetic peptide
SSYAMG

SEQ ID NO: 20 - protein, 16 aa, Artificial Sequence
  Description of Artificial Sequence: Synthetic peptide
TINDGGTAFYASWVKG

SEQ ID NO: 21 - protein, 15 aa, Artificial Sequence
  Description of Artificial Sequence: Synthetic peptide
AYGSNGDVYWGYFNL

SEQ ID NO: 22 - protein, 11 aa, Artificial Sequence
  Description of Artificial Sequence: Synthetic peptide
QASQSIGSYLS

SEQ ID NO: 23 - protein, 7 aa, Artificial Sequence
  Description of Artificial Sequence: Synthetic peptide
RASTLAS

SEQ ID NO: 24 - protein, 12 aa, Artificial Sequence
  Description of Artificial Sequence: Synthetic peptide
QQGYSSTNLDNV

SEQ ID NO: 25 - protein, 252 aa, Artificial Sequence
  Description of Artificial Sequence: Synthetic polypeptide
QEQLEESGGGLVTPGGTLTLTCTVSGFSLSNYAMGWVRQAPGKGLEWIGTINDGGTAFYAKWLKGRFTISRTSTTVDLKITSPTTEDTATYFCARAYGSNGDVYWGYFNLWGQGTLVTISSGGGGSGGGGSGGGGSGGGGASELVMTQTPSSVSEPVGGTVTIKCQASQSIGSNLAWYQQRPGQPPKLLIYSASTLASGVSSRFKGSGSGTESTLTISGVQAADAATYYCQQGYSSSNVDNVFGGGTELEIL

SEQ ID NO: 26 - protein, 121 aa, Artificial Sequence
  Description of Artificial Sequence: Synthetic polypeptide
QEQLEESGGGLVTPGGTLTLTCTVSGFSLSNYAMGWVRQAPGKGLEWIGTINDGGTAFYAKWLKGRFTISRTSTTVDLKITSPTTEDTATYFCARAYGSNGDVYWGYFNLWGQGTLVTISS

SEQ ID NO: 27 - protein, 110 aa, Artificial Sequence
  Description of Artificial Sequence: Synthetic polypeptide
ELVMTQTPSSVSEPVGGTVTIKCQASQSIGSNLAWYQQRPGQPPKLLIYSASTLASGVSSRFKGSGSGTESTLTISGVQAADAATYYCQQGYSSSNVDNVFGGGTELEIL

SEQ ID NO: 28 - protein, 6 aa, Artificial Sequence
  Description of Artificial Sequence: Synthetic peptide
SNYAMG

SEQ ID NO: 29 - protein, 16 aa, Artificial Sequence
  Description of Artificial Sequence: Synthetic peptide
TINDGGTAFYAKWLKG

SEQ ID NO: 30 - protein, 15 aa, Artificial Sequence
  Description of Artificial Sequence: Synthetic peptide
AYGSNGDVYWGYFNL

SEQ ID NO: 31 - protein, 11 aa, Artificial Sequence
  Description of Artificial Sequence: Synthetic peptide
QASQSIGSNLA

SEQ ID NO: 32 - protein, 7 aa, Artificial Sequence
  Description of Artificial Sequence: Synthetic peptide
SASTLAS

SEQ ID NO: 33 - protein, 12 aa, Artificial Sequence
  Description of Artificial Sequence: Synthetic peptide
QQGYSSSNVDNV

SEQ ID NO: 34 - protein, 252 aa, Artificial Sequence
  Description of Artificial Sequence: Synthetic polypeptide
QEQLEESGGGLVTPGTPLTLTCTASGFSLSSYAMIWVRQAPGKGLEWIGTINDGGTAFYANWVKGRFTISRTSTTVDLKMTSPTTEDTATYFCARAYGSNGDVYWGYVNLWGQGTLVTVSSGGGGSGGGGSGGGGSGGGGASELVMTQTPASVSEPVGGTVTIKCQASQSIGSNLAWYQQKPGQPPKLLIYAAANLASGVSSRFKGSRSGTEYTLTISGVQAADAATYYCQQGYSSSNVANVFGGGTELEIL

SEQ ID NO: 35 - protein, 121 aa, Artificial Sequence
  Description of Artificial Sequence: Synthetic polypeptide
QEQLEESGGGLVTPGTPLTLTCTASGFSLSSYAMIWVRQAPGKGLEWIGTINDGGTAFYANWVKGRFTISRTSTTVDLKMTSPTTEDTATYFCARAYGSNGDVYWGYVNLWGQGTLVTVSS

SEQ ID NO: 36 - protein, 110 aa, Artificial Sequence
  Description of Artificial Sequence: Synthetic polypeptide
ELVMTQTPASVSEPVGGTVTIKCQASQSIGSNLAWYQQKPGQPPKLLIYAAANLASGVSSRFKGSRSGTEYTLTISGVQAADAATYYCQQGYSSSNVANVFGGGTELEIL

SEQ ID NO: 37 - protein, 6 aa, Artificial Sequence
  Description of Artificial Sequence: Synthetic peptide
SSYAMI

SEQ ID NO: 38 - protein, 16 aa, Artificial Sequence
  Description of Artificial Sequence: Synthetic peptide
TINDGGTAFYANWVKG

SEQ ID NO: 39 - protein, 15 aa, Artificial Sequence
  Description of Artificial Sequence: Synthetic peptide
AYGSNGDVYWGYVNL

SEQ ID NO: 40 - protein, 11 aa, Artificial Sequence
  Description of Artificial Sequence: Synthetic peptide
QASQSIGSNLA

SEQ ID NO: 41 - protein, 7 aa, Artificial Sequence
  Description of Artificial Sequence: Synthetic peptide
AAANLAS

SEQ ID NO: 42 - protein, 12 aa, Artificial Sequence
  Description of Artificial Sequence: Synthetic peptide
QQGYSSSNVANV

SEQ ID NO: 43 - protein, 252 aa, Artificial Sequence
  Description of Artificial Sequence: Synthetic polypeptide
QEQLEESGGGLVTPGTPLTLTCTASGFSLSSYAMIWVRQAPGKGLEWIGTINDGGTAFYASWVKGRFTISRTSTTVDLKITSPTTEDTATYFCARAYGSNGDVYWGYVNLWGQGTLVTISSGGGGSGGGGSGGGGSGGGGASELVMTQTPSSVSAAVGGTVTINCQASQNIGSVFAWYQQKPGQPPKLLIYKASSLASGVPSRFKGSGSGTQFTLTISGVEAADAATYYCQQGASSSNVDNIFGGGTEVVVK

SEQ ID NO: 44 - protein, 121 aa, Artificial Sequence
  Description of Artificial Sequence: Synthetic polypeptide
QEQLEESGGGLVTPGTPLTLTCTASGFSLSSYAMIWVRQAPGKGLEWIGTINDGGTAFYASWVKGRFTISRTSTTVDLKITSPTTEDTATYFCARAYGSNGDVYWGYVNLWGQGTLVTISS

SEQ ID NO: 45 - protein, 110 aa, Artificial Sequence
  Description of Artificial Sequence: Synthetic polypeptide
ELVMTQTPSSVSAAVGGTVTINCQASQNIGSVFAWYQQKPGQPPKLLIYKASSLASGVPSRFKGSGSGTQFTLTISGVEAADAATYYCQQGASSSNVDNIFGGGTEVVVK

SEQ ID NO: 46 - protein, 6 aa, Artificial Sequence
  Description of Artificial Sequence: Synthetic peptide
SSYAMI

SEQ ID NO: 47 - protein, 16 aa, Artificial Sequence
  Description of Artificial Sequence: Synthetic peptide
TINDGGTAFYASWVKG

SEQ ID NO: 48 - protein, 15 aa, Artificial Sequence
  Description of Artificial Sequence: Synthetic peptide
AYGSNGDVYWGYVNL

SEQ ID NO: 49 - protein, 11 aa, Artificial Sequence
  Description of Artificial Sequence: Synthetic peptide
QASQNIGSVFA

SEQ ID NO: 50 - protein, 7 aa, Artificial Sequence
  Description of Artificial Sequence: Synthetic peptide
KASSLAS

SEQ ID NO: 51 - protein, 12 aa, Artificial Sequence
  Description of Artificial Sequence: Synthetic peptide
QQGASSSNVDNI

SEQ ID NO: 52 - protein, 253 aa, Artificial Sequence
  Description of Artificial Sequence: Synthetic polypeptide
QQQLEESGGGLVTPGTPLTLTCTVSGFSLSNYAMGWVRQAPGKGLEWIGTINDGGTAFYANWLKGRFTISRTSTTVDLKITSPTTEDTATYFCARAYGSNGDVYWGYFNLWGQGTLVTVSSGGGGSGGGGSGGGGSGGGGASELVMTQTASPVSAAVGGTVTINCQASQSISSRSLSWYQQKPGQPPKLLIYEASKLASGVPSRFSGSGSGTQFTLTISGVQADDAATYYCQQGYSSSNVDNVFGGGTEVVVK

SEQ ID NO: 53 - protein, 121 aa, Artificial Sequence
  Description of Artificial Sequence: Synthetic polypeptide
QQQLEESGGGLVTPGTPLTLTCTVSGFSLSNYAMGWVRQAPGKGLEWIGTINDGGTAFYANWLKGRFTISRTSTTVDLKITSPTTEDTATYFCARAYGSNGDVYWGYFNLWGQGTLVTVSS

SEQ ID NO: 54 - protein, 111 aa, Artificial Sequence
  Description of Artificial Sequence: Synthetic polypeptide
ELVMTQTASPVSAAVGGTVTINCQASQSISSRSLSWYQQKPGQPPKLLIYEASKLASGVPSRFSGSGSGTQFTLTISGVQADDAATYYCQQGYSSSNVDNVFGGGTEVVVK

SEQ ID NO: 55 - protein, 6 aa, Artificial Sequence
  Description of Artificial Sequence: Synthetic peptide
SNYAMG

SEQ ID NO: 56 - protein, 16 aa, Artificial Sequence
  Description of Artificial Sequence: Synthetic peptide
TINDGGTAFYANWLKG

SEQ ID NO: 57 - protein, 15 aa, Artificial Sequence
  Description of Artificial Sequence: Synthetic peptide
AYGSNGDVYWGYFNL

SEQ ID NO: 58 - protein, 12 aa, Artificial Sequence
  Description of Artificial Sequence: Synthetic peptide
QASQSISSRSLS

SEQ ID NO: 59 - protein, 7 aa, Artificial Sequence
  Description of Artificial Sequence: Synthetic peptide
EASKLAS

SEQ ID NO: 60 - protein, 12 aa, Artificial Sequence
  Description of Artificial Sequence: Synthetic peptide
QQGYSSSNVDNV

SEQ ID NO: 61 - protein, 252 aa, Artificial Sequence
  Description of Artificial Sequence: Synthetic polypeptide
QQQLVESGGGLVTPGTPLTLTCTVSGFSLSNYAMGWVRQAPGKGLEWIGTINDGGTAFYANWLKGRFTISRTSTTVDLKITSPTTEDTATYFCARAYGSNGDVYWGYFNLWGQGTLVTVSSGGGGSGGGGSGGGGSGGGGASELVMTQTASPVSAAVGGTVTINCQASQSISSRSLSWYQQKPGQPPKLLIYEASKLASGVPSRFSGSGSGTQFTLTISGVQADDAATYYCQQGYSSSNVDNFGGGTEVVVK

SEQ ID NO: 62 - protein, 121 aa, Artificial Sequence
  Description of Artificial Sequence: Synthetic polypeptide
QQQLVESGGGLVTPGTPLTLTCTVSGFSLSNYAMGWVRQAPGKGLEWIGTINDGGTAFYANWLKGRFTISRTSTTVDLKITSPTTEDTATYFCARAYGSNGDVYWGYFNLWGQGTLVTVSS

SEQ ID NO: 63 - protein, 110 aa, Artificial Sequence
  Description of Artificial Sequence: Synthetic polypeptide
ELVMTQTASPVSAAVGGTVTINCQASQSISSRSLSWYQQKPGQPPKLLIYEASKLASGVPSRFSGSGSGTQFTLTISGVQADDAATYYCQQGYSSSNVDNFGGGTEVVVK

SEQ ID NO: 64 - protein, 6 aa, Artificial Sequence
  Description of Artificial Sequence: Synthetic peptide
SNYAMG

SEQ ID NO: 65 - protein, 16 aa, Artificial Sequence
  Description of Artificial Sequence: Synthetic peptide
TINDGGTAFYANWLKG

SEQ ID NO: 66 - protein, 15 aa, Artificial Sequence
  Description of Artificial Sequence: Synthetic peptide
AYGSNGDVYWGYFNL

SEQ ID NO: 67 - protein, 12 aa, Artificial Sequence
  Description of Artificial Sequence: Synthetic peptide
QASQSISSRSLS

SEQ ID NO: 68 - protein, 7 aa, Artificial Sequence
  Description of Artificial Sequence: Synthetic peptide
EASKLAS

SEQ ID NO: 69 - protein, 11 aa, Artificial Sequence
  Description of Artificial Sequence: Synthetic peptide
QQGYSSSNVDN

SEQ ID NO: 70 - protein, 251 aa, Artificial Sequence
  Description of Artificial Sequence: Synthetic polypeptide
QSVKESWGRLVTPGGSLTLTCTVSGIDLNNYAMGWVRQAPGKGLEWIGTINNDGATYYPSWARGRFTISKTSTTVDLKITSPTTEDTATYFCARTYGSNGDVYWGYFNLWGQGTLVTVSSGGGGSGGGGSGGGGSGGGGASALELTQTPASVEVAVGGTVTINCQASQSIGGALNWYQQKSGQPPKLLIYLASTLASGVSSRFKGSGSGTQFTLTISGVEAADAATYYCQQGYSASNIDNAFGGGTEVVVK

SEQ ID NO: 71 - protein, 120 aa, Artificial Sequence
  Description of Artificial Sequence: Synthetic polypeptide
QSVKESWGRLVTPGGSLTLTCTVSGIDLNNYAMGWVRQAPGKGLEWIGTINNDGATYYPSWARGRFTISKTSTTVDLKITSPTTEDTATYFCARTYGSNGDVYWGYFNLWGQGTLVTVSS

SEQ ID NO: 72 - protein, 110 aa, Artificial Sequence
  Description of Artificial Sequence: Synthetic polypeptide
ALELTQTPASVEVAVGGTVTINCQASQSIGGALNWYQQKSGQPPKLLIYLASTLASGVSSRFKGSGSGTQFTLTISGVEAADAATYYCQQGYSASNIDNAFGGGTEVVVK

SEQ ID NO: 73 - protein, 6 aa, Artificial Sequence
  Description of Artificial Sequence: Synthetic peptide
NNYAMG

SEQ ID NO: 74 - protein, 16 aa, Artificial Sequence
  Description of Artificial Sequence: Synthetic peptide
TINNDGATYYPSWARG

SEQ ID NO: 75 - protein, 15 aa, Artificial Sequence
  Description of Artificial Sequence: Synthetic peptide
TYGSNGDVYWGYFNL

SEQ ID NO: 76 - protein, 11 aa, Artificial Sequence
  Description of Artificial Sequence: Synthetic peptide
QASQSIGGALN

SEQ ID NO: 77 - protein, 7 aa, Artificial Sequence
  Description of Artificial Sequence: Synthetic peptide
LASTLAS

SEQ ID NO: 78 - protein, 12 aa, Artificial Sequence
  Description of Artificial Sequence: Synthetic peptide
QQGYSASNIDNA

SEQ ID NO: 79 - protein, 252 aa, Artificial Sequence
  Description of Artificial Sequence: Synthetic polypeptide
QQQLEESGGGLVTPGTPLTLTCTVSGIDLSSYAMGWVRQAPGKGLEWIGTINDGGSAFYASWVKGRFTISRTSTTVDLKITSPTAEDTATYFCAKTYGTNGDVYWGYFNLWGQGTLVTISSGGGGSGGGGSGGGGSGGGGASELVMTQTPASVSEPVGGTVTIKCQASQSIGSNLAWYQQKPGQPPKLLIYYESILASGVPSRFSGSGSGTEYTLTISGAQADDAATYYCQQGYSSSNIDNAFGGGTEVVVK

SEQ ID NO: 80 - protein, 121 aa, Artificial Sequence
  Description of Artificial Sequence: Synthetic polypeptide
QQQLEESGGGLVTPGTPLTLTCTVSGIDLSSYAMGWVRQAPGKGLEWIGTINDGGSAFYASWVKGRFTISRTSTTVDLKITSPTAEDTATYFCAKTYGTNGDVYWGYFNLWGQGTLVTISS

SEQ ID NO: 81 - protein, 110 aa, Artificial Sequence
  Description of Artificial Sequence: Synthetic polypeptide
ELVMTQTPASVSEPVGGTVTIKCQASQSIGSNLAWYQQKPGQPPKLLIYYESILASGVPSRFSGSGSGTEYTLTISGAQADDAATYYCQQGYSSSNIDNAFGGGTEVVVK

SEQ ID NO: 82 - protein, 6 aa, Artificial Sequence
  Description of Artificial Sequence: Synthetic peptide
SSYAMG

SEQ ID NO: 83 - protein, 16 aa, Artificial Sequence
  Description of Artificial Sequence: Synthetic peptide
TINDGGSAFYASWVKG

SEQ ID NO: 84 - protein, 15 aa, Artificial Sequence
  Description of Artificial Sequence: Synthetic peptide
TYGTNGDVYWGYFNL

SEQ ID NO: 85 - protein, 11 aa, Artificial Sequence
  Description of Artificial Sequence: Synthetic peptide
QASQSIGSNLA

SEQ ID NO: 86 - protein, 7 aa, Artificial Sequence
  Description of Artificial Sequence: Synthetic peptide
YESILAS

SEQ ID NO: 87 - protein, 12 aa, Artificial Sequence
  Description of Artificial Sequence: Synthetic peptide
QQGYSSSNIDNA

SEQ ID NO: 88 - protein, 252 aa, Artificial Sequence
  Description of Artificial Sequence: Synthetic polypeptide
QQQLEESGGGLVTPGTPLTLTCTVSGIDLSSYAMGWVRQAPGKGLEWIGTINDGGSAFYASWVKGRFTISRTSTTVDLKITSPTAEDTATYFCAKTYGTNGDVYWGYFNLWGQGTLVTISSGGGGSGGGGSGGGGSGGGGASELVMTQTPASVSEPVGGTVTIKCQASQSIGSNLAWYQQKPGQPPKLLIYYESILASGVPSRFSGSGSGTEYTLTISGAQADDAATYYCQQGYSSSNILNAFGGGTEVVVK

SEQ ID NO: 89 - protein, 121 aa, Artificial Sequence; identical to SEQ ID NO: 80
  Description of Artificial Sequence: Synthetic polypeptide

SEQ ID NO: 90 - protein, 110 aa, Artificial Sequence
  Description of Artificial Sequence: Synthetic polypeptide
ELVMTQTPASVSEPVGGTVTIKCQASQSIGSNLAWYQQKPGQPPKLLIYYESILASGVPSRFSGSGSGTEYTLTISGAQADDAATYYCQQGYSSSNILNAFGGGTEVVVK

SEQ ID NO: 91 - protein, 6 aa, Artificial Sequence
  Description of Artificial Sequence: Synthetic peptide
SSYAMG

SEQ ID NO: 92 - protein, 16 aa, Artificial Sequence
  Description of Artificial Sequence: Synthetic peptide
TINDGGSAFYASWVKG

SEQ ID NO: 93 - protein, 15 aa, Artificial Sequence
  Description of Artificial Sequence: Synthetic peptide
TYGTNGDVYWGYFNL

SEQ ID NO: 94 - protein, 11 aa, Artificial Sequence
  Description of Artificial Sequence: Synthetic peptide
QASQSIGSNLA

SEQ ID NO: 95 - protein, 7 aa, Artificial Sequence
  Description of Artificial Sequence: Synthetic peptide
YESILAS

SEQ ID NO: 96 - protein, 12 aa, Artificial Sequence
  Description of Artificial Sequence: Synthetic peptide
QQGYSSSNILNA

SEQ ID NO: 97 - protein, 250 aa, Artificial Sequence
  Description of Artificial Sequence: Synthetic polypeptide
QQQLVESGGRLVTPGTPLTLTCTASGIDLNSNAMSWVRQGPGKGLEWIGDIWSGGYTDYASWAKGRFTISKTSTTVDLKMTSLTAADTATYFCARDRLAGDGVVDYDLWGQGTLVTISSGGGGSGGGGSGGGGSGGGGASELDMTQTPASVEVAVGGTVTIKCQASQNIYSNLAWYQQKPGQRPKLLIYGASTLASGVPSRFKGSGSGTEYTLTINGVQAADAATYYCQQGFSSSNVDNVFGGGTEVVVK

SEQ ID NO: 98 - protein, 119 aa, Artificial Sequence
  Description of Artificial Sequence: Synthetic polypeptide
QQQLVESGGRLVTPGTPLTLTCTASGIDLNSNAMSWVRQGPGKGLEWIGDIWSGGYTDYASWAKGRFTISKTSTTVDLKMTSLTAADTATYFCARDRLAGDGVVDYDLWGQGTLVTISS

SEQ ID NO: 99 - protein, 110 aa, Artificial Sequence
  Description of Artificial Sequence: Synthetic polypeptide
ELDMTQTPASVEVAVGGTVTIKCQASQNIYSNLAWYQQKPGQRPKLLIYGASTLASGVPSRFKGSGSGTEYTLTINGVQAADAATYYCQQGFSSSNVDNVFGGGTEVVVK

SEQ ID NO: 100 - protein, 6 aa, Artificial Sequence
  Description of Artificial Sequence: Synthetic peptide
NSNAMS

SEQ ID NO: 101 - protein, 16 aa, Artificial Sequence
  Description of Artificial Sequence: Synthetic peptide
DIWSGGYTDYASWAKG

SEQ ID NO: 102 - protein, 13 aa, Artificial Sequence
  Description of Artificial Sequence: Synthetic peptide
DRLAGDGVVDYDL

SEQ ID NO: 103 - protein, 7 aa, Artificial Sequence
  Description of Artificial Sequence: Synthetic peptide
GASTLAS

SEQ ID NO: 104 - protein, 12 aa, Artificial Sequence
  Description of Artificial Sequence: Synthetic peptide
QQGFSSSNVDNV

SEQ ID NO: 105 - protein, 252 aa, Artificial Sequence
  Description of Artificial Sequence: Synthetic polypeptide
QSVEESGGRLVTPGTPLTLTCTVSGFSLSNYAMSWVRQAPGKGLEYIGIVSSGGTTYYASWAKGRFTISKTSTTVDLKITSPTTEDTATYFCAKDLYYGPTTYSAFNLWGQGTLVTVSSGGGGSGGGGSGGGGSGGGGASELVLTQPQSVSGSLGQTVSISCKRARNNIEDYYVHWYQQHPGRSPTIVIHKDDQRPSGVPDRFSGSIDSTSNSASLTITGLLAEDEADYFCQSFDNNANPVFGGGTQLTVTG

SEQ ID NO: 106 - protein, 119 aa, Artificial Sequence
  Description of Artificial Sequence: Synthetic polypeptide
QSVEESGGRLVTPGTPLTLTCTVSGFSLSNYAMSWVRQAPGKGLEYIGIVSSGGTTYYASWAKGRFTISKTSTTVDLKITSPTTEDTATYFCAKDLYYGPTTYSAFNLWGQGTLVTVSS

SEQ ID NO: 107 - protein, 112 aa, Artificial Sequence
  Description of Artificial Sequence: Synthetic polypeptide
ELVLTQPQSVSGSLGQTVSISCKRARNNIEDYYVHWYQQHPGRSPTIVIHKDDQRPSGVPDRFSGSIDSTSNSASLTITGLLAEDEADYFCQSFDNNANPVFGGGTQLTVTG

SEQ ID NO: 108 - protein, 6 aa, Artificial Sequence
  Description of Artificial Sequence: Synthetic peptide
SNYAMS

SEQ ID NO: 109 - protein, 16 aa, Artificial Sequence
  Description of Artificial Sequence: Synthetic peptide
IVSSGGTTYYASWAKG

SEQ ID NO: 110 - protein, 14 aa, Artificial Sequence
  Description of Artificial Sequence: Synthetic peptide
DLYYGPTTYSAFNL

SEQ ID NO: 111 - protein, 13 aa, Artificial Sequence
  Description of Artificial Sequence: Synthetic peptide
KRARNNIEDYYVH

SEQ ID NO: 112 - protein, 7 aa, Artificial Sequence
  Description of Artificial Sequence: Synthetic peptide
KDDQRPS

SEQ ID NO: 113 - protein, 10 aa, Artificial Sequence
  Description of Artificial Sequence: Synthetic peptide
QSFDNNANPV

SEQ ID NO: 114 - protein, 252 aa, Artificial Sequence
  Description of Artificial Sequence: Synthetic polypeptide
QSVKESGGRLVTPGTPLTLTCTVSGFSLSNYAMSWVRQAPGKGLEYIGIVSSGGTTYYASWAKGRFTISKTSTTVDLKITSPTTEDTATYFCAKDLYYGPTTYSAFNLWGQGTLVTISSGGGGSGGGGSGGGGSGGGGASELVLTQPQSVSGSLGQTVSISCKRARDNIEDYYVHWYQQHPGKTPTIVIHKDDQRPSGVPDRFSGSIDSTSNSASLTITGLLAEDEADYFCQSFDNDASPVFGGGTQLTVTG

SEQ ID NO: 115 - protein, 119 aa, Artificial Sequence
  Description of Artificial Sequence: Synthetic polypeptide
QSVKESGGRLVTPGTPLTLTCTVSGFSLSNYAMSWVRQAPGKGLEYIGIVSSGGTTYYASWAKGRFTISKTSTTVDLKITSPTTEDTATYFCAKDLYYGPTTYSAFNLWGQGTLVTISS

SEQ ID NO: 116 - protein, 112 aa, Artificial Sequence
  Description of Artificial Sequence: Synthetic polypeptide
ELVLTQPQSVSGSLGQTVSISCKRARDNIEDYYVHWYQQHPGKTPTIVIHKDDQRPSGVPDRFSGSIDSTSNSASLTITGLLAEDEADYFCQSFDNDASPVFGGGTQLTVTG

SEQ ID NO: 117 - protein, 6 aa, Artificial Sequence
  Description of Artificial Sequence: Synthetic peptide
SNYAMS

SEQ ID NO: 118 - protein, 16 aa, Artificial Sequence
  Description of Artificial Sequence: Synthetic peptide
IVSSGGTTYYASWAKG

SEQ ID NO: 119 - protein, 14 aa, Artificial Sequence
  Description of Artificial Sequence: Synthetic peptide
DLYYGPTTYSAFNL

SEQ ID NO: 120 - protein, 13 aa, Artificial Sequence
  Description of Artificial Sequence: Synthetic peptide
KRARDNIEDYYVH

SEQ ID NO: 121 - protein, 7 aa, Artificial Sequence
  Description of Artificial Sequence: Synthetic peptide
KDDQRPS

SEQ ID NO: 122 - protein, 10 aa, Artificial Sequence
  Description of Artificial Sequence: Synthetic peptide
QSFDNDASPV

SEQ ID NO: 123 - protein, 252 aa, Artificial Sequence
  Description of Artificial Sequence: Synthetic polypeptide
QSVKESGGRLVTPGTPLTLTCTVSGFSLSNYAMSWVRQAPGKGLEYIGIVSSGGTTYYASWAKGRFTISKTSTTVDLKITSPTTEDTATYFCAKDLYYGPTTYSAFNLWGQGTLVTISSGGGGSGGGGSGGGGSGGGGASELVLTQPQSVSGSLGQTVSISCKRARDNIEDYYVHWYQQYPGKTPTIVIYKDDQRPSGVPDRFSGSIDSTSNSASLTITGLLAEDEADYFCQSFDNNANVVFGGGTQLTVTG

SEQ ID NO: 124 - protein, 119 aa, Artificial Sequence; identical to SEQ ID NO: 115
  Description of Artificial Sequence: Synthetic polypeptide

SEQ ID NO: 125 - protein, 112 aa, Artificial Sequence
  Description of Artificial Sequence: Synthetic polypeptide
ELVLTQPQSVSGSLGQTVSISCKRARDNIEDYYVHWYQQYPGKTPTIVIYKDDQRPSGVPDRFSGSIDSTSNSASLTITGLLAEDEADYFCQSFDNNANVVFGGGTQLTVTG

SEQ ID NO: 126 - protein, 6 aa, Artificial Sequence
  Description of Artificial Sequence: Synthetic peptide
SNYAMS

SEQ ID NO: 127 - protein, 16 aa, Artificial Sequence
  Description of Artificial Sequence: Synthetic peptide
IVSSGGTTYYASWAKG

SEQ ID NO: 128 - protein, 14 aa, Artificial Sequence
  Description of Artificial Sequence: Synthetic peptide
DLYYGPTTYSAFNL

SEQ ID NO: 129 - protein, 13 aa, Artificial Sequence
  Description of Artificial Sequence: Synthetic peptide
KRARDNIEDYYVH

SEQ ID NO: 130 - protein, 7 aa, Artificial Sequence
  Description of Artificial Sequence: Synthetic peptide
KDDQRPS

SEQ ID NO: 131 - protein, 10 aa, Artificial Sequence
  Description of Artificial Sequence: Synthetic peptide
QSFDNNANVV

SEQ ID NO: 132 - protein, 250 aa, Artificial Sequence
  Description of Artificial Sequence: Synthetic polypeptide
QSVKESGGRLVTPGTPLTLTCTVSGFSLSNYAMSWVRQAPGKGLEYIGIVSSGGTTYYASWAKGRFTISKTSTTVDLKITSPTTEDTATYFCAKDLYYGPTTYSAFNLWGQGTLVTISSGGGGSGGGGSGGGGSGGGGASELVLTQPASVQVNLGQTVSLTCTADTLSRSYASWYQLKPGQAPVLLIYRDTSRPSGVPDRFSGSSSGNTATLTISGAQAGDEGDYVCATSDGSGSNFQLFGGGTQLTVTG

SEQ ID NO: 133 - protein, 119 aa, Artificial Sequence; identical to SEQ ID NO: 115
  Description of Artificial Sequence: Synthetic polypeptide

SEQ ID NO: 134 - protein, 110 aa, Artificial Sequence
  Description of Artificial Sequence: Synthetic polypeptide
ELVLTQPASVQVNLGQTVSLTCTADTLSRSYASWYQLKPGQAPVLLIYRDTSRPSGVPDRFSGSSSGNTATLTISGAQAGDEGDYVCATSDGSGSNFQLFGGGTQLTVTG

SEQ ID NO: 135 - protein, 6 aa, Artificial Sequence
  Description of Artificial Sequence: Synthetic peptide
SNYAMS

SEQ ID NO: 136 - protein, 16 aa, Artificial Sequence
  Description of Artificial Sequence: Synthetic peptide
IVSSGGTTYYASWAKG

SEQ ID NO: 137 - protein, 14 aa, Artificial Sequence
  Description of Artificial Sequence: Synthetic peptide
DLYYGPTTYSAFNL

SEQ ID NO: 138 - protein, 11 aa, Artificial Sequence
  Description of Artificial Sequence: Synthetic peptide
TADTLSRSYAS

SEQ ID NO: 139 - protein, 7 aa, Artificial Sequence
  Description of Artificial Sequence: Synthetic peptide
RDTSRPS

SEQ ID NO: 140 - protein, 12 aa, Artificial Sequence
  Description of Artificial Sequence: Synthetic peptide
ATSDGSGSNFQL

SEQ ID NO: 141 - protein, 252 aa, Artificial Sequence
  Description of Artificial Sequence: Synthetic polypeptide
PEQLMESGGGLVTPGGVLTLTCTASGFSFSSYGVNWVRQAPGKGLEWIGFIFGDGTTYYANWAKGRFTISKTSTTVDLKMTSPTTEDTATYFCARDGYGGYDYIINLWGQGTLVTVSSGGGGSGGGGSGGGGSGGGGASAQVLTQTPASVSAAVGGTVSISCQSSQSVVNNNWLAWYQQKPGQPPKLLIYKASTLESGVPSRFKGSGSGTQFTLTISGVQADDAATYYCLGEFSCSSADCHAFGGGTELEIL

SEQ ID NO: 142 - protein, 118 aa, Artificial Sequence
  Description of Artificial Sequence: Synthetic polypeptide
PEQLMESGGGLVTPGGVLTLTCTASGFSFSSYGVNWVRQAPGKGLEWIGFIFGDGTTYYANWAKGRFTISKTSTTVDLKMTSPTTEDTATYFCARDGYGGYDYIINLWGQGTLVTVSS

SEQ ID NO: 143 - protein, 113 aa, Artificial Sequence
  Description of Artificial Sequence: Synthetic polypeptide
AQVLTQTPASVSAAVGGTVSISCQSSQSVVNNNWLAWYQQKPGQPPKLLIYKASTLESGVPSRFKGSGSGTQFTLTISGVQADDAATYYCLGEFSCSSADCHAFGGGTELEIL

SEQ ID NO: 144 - protein, 5 aa, Artificial Sequence
  Description of Artificial Sequence: Synthetic peptide
SYGVN

SEQ ID NO: 145 - protein, 16 aa, Artificial Sequence
  Description of Artificial Sequence: Synthetic peptide
FIFGDGTTYYANWAKG

SEQ ID NO: 146 - protein, 12 aa, Artificial Sequence
  Description of Artificial Sequence: Synthetic peptide
DGYGGYDYIINL

SEQ ID NO: 147 - protein, 10 aa, Artificial Sequence
  Description of Artificial Sequence: Synthetic peptide
QSSQSVVNNN

SEQ ID NO: 148 - protein, 7 aa, Artificial Sequence
  Description of Artificial Sequence: Synthetic peptide
KASTLES

SEQ ID NO: 149 - protein, 13 aa, Artificial Sequence
  Description of Artificial Sequence: Synthetic peptide
LGEFSCSSADCHA

SEQ ID NO: 150 - protein, 251 aa, Artificial Sequence
  Description of Artificial Sequence: Synthetic polypeptide
PEQLMESGGGLVTPGGVLTLTCTASGFSFSSYGVNWVRQAPGKGLEWIGFIFGDGTTYYANWAKGRFTISKTSTTVDLKMTSPTTEDTATYFCARDGYGGYDYIINLWGQGTLVTVSSGGGGSGGGGSGGGGSGGGGASAQVLTQTPASVSAAVGGTVSISCQSSQSVVNNNWLAWYQQKPGQPPKLLIYKASTLESGVPSRFKGSGSGTQFTLTISGVQADDAATYYCQGAYSGNIYYNAFGGGTEVVVK

SEQ ID NO: 151 - protein, 118 aa, Artificial Sequence; identical to SEQ ID NO: 142
  Description of Artificial Sequence: Synthetic polypeptide

SEQ ID NO: 152 - protein, 112 aa, Artificial Sequence
  Description of Artificial Sequence: Synthetic polypeptide
AQVLTQTPASVSAAVGGTVSISCQSSQSVVNNNWLAWYQQKPGQPPKLLIYKASTLESGVPSRFKGSGSGTQFTLTISGVQADDAATYYCQGAYSGNIYYNAFGGGTEVVVK

SEQ ID NO: 153 - protein, 6 aa, Artificial Sequence
  Description of Artificial Sequence: Synthetic peptide
SSYGVN

SEQ ID NO: 154 - protein, 16 aa, Artificial Sequence
  Description of Artificial Sequence: Synthetic peptide
FIFGDGTTYYANWAKG

SEQ ID NO: 155 - protein, 12 aa, Artificial Sequence
  Description of Artificial Sequence: Synthetic peptide
DGYGGYDYIINL

SEQ ID NO: 156 - protein, 10 aa, Artificial Sequence
  Description of Artificial Sequence: Synthetic peptide
QSSQSVVNNN

SEQ ID NO: 157 - protein, 7 aa, Artificial Sequence
  Description of Artificial Sequence: Synthetic peptide
KASTLES

SEQ ID NO: 158 - protein, 12 aa, Artificial Sequence
  Description of Artificial Sequence: Synthetic peptide
QGAYSGNIYYNA

SEQ ID NO: 159 - protein, 245 aa, Artificial Sequence
  Description of Artificial Sequence: Synthetic polypeptide
QSVKESGGGLVTPGTPLTLTCTVSGFSLSTYAISWVRQAPGKGLEWIGFIDTVDSAYYASWAKGRFTISKTSSTTVDLKMTSPTTEDTATYFCAKLRYGDYGDYTLWGQGTLVTVSSGGGGSGGGGSGGGGSGGGGASELVMTQTPSPVSGAVGGTVTIKCQASQNIYSYLAWYQQKPGQPPKLLIYKASTLASGVPSRVKGSGSGTEYTLTISGVQAADAATYYCQCTYYDSNTFGGGTEVVVK

SEQ ID NO: 160 - protein, 117 aa, Artificial Sequence
  Description of Artificial Sequence: Synthetic polypeptide
QSVKESGGGLVTPGTPLTLTCTVSGFSLSTYAISWVRQAPGKGLEWIGFIDTVDSAYYASWAKGRFTISKTSSTTVDLKMTSPTTEDTATYFCAKLRYGDYGDYTLWGQGTLVTVSS

SEQ ID NO: 161 - protein, 107 aa, Artificial Sequence
  Description of Artificial Sequence: Synthetic polypeptide
ELVMTQTPSPVSGAVGGTVTIKCQASQNIYSYLAWYQQKPGQPPKLLIYKASTLASGVPSRVKGSGSGTEYTLTISGVQAADAATYYCQCTYYDSNTFGGGTEVVVK

SEQ ID NO: 162 - protein, 6 aa, Artificial Sequence
  Description of Artificial Sequence: Synthetic peptide
STYAIS

SEQ ID NO: 163 - protein, 16 aa, Artificial Sequence
  Description of Artificial Sequence: Synthetic peptide
FIDTVDSAYYASWAKG

SEQ ID NO: 164 - protein, 11 aa, Artificial Sequence
  Description of Artificial Sequence: Synthetic peptide
LRYGDYGDYTL

SEQ ID NO: 165 - protein, 11 aa, Artificial Sequence
  Description of Artificial Sequence: Synthetic peptide
QASQNIYSYLA

SEQ ID NO: 166 - protein, 7 aa, Artificial Sequence
  Description of Artificial Sequence: Synthetic peptide
KASTLAS

SEQ ID NO: 167 - protein, 9 aa, Artificial Sequence
  Description of Artificial Sequence: Synthetic peptide
QCTYYDSNT

SEQ ID NO: 168 - protein, 249 aa, Artificial Sequence
  Description of Artificial Sequence: Synthetic polypeptide
PAALMESGGRLVTPGTPLTLTCTVSGIDLSTFAMTWVRQAPGKGLEWLGIINTGGSAYYTSWAKGRFTISRTSTTVDLKITSPTTEDTATYFCARGDWSSATDLWGQGTLVTISSGGGGSGGGGSGGGGSGGGGASDPDMTQTPSSVSAAVGGTVTINCQASQSVYDNKVLAWYRQKPGQPPKLLIYKASTLASGVPSRFKGRGSGTQFTLTISGVQADDAATYYCLGEFSCSSADCHAFGGGTELEIL

SEQ ID NO: 169 - protein, 115 aa, Artificial Sequence
  Description of Artificial Sequence: Synthetic polypeptide
PAALMESGGRLVTPGTPLTLTCTVSGIDLSTFAMTWVRQAPGKGLEWLGIINTGGSAYYTSWAKGRFTISRTSTTVDLKITSPTTEDTATYFCARGDWSSATDLWGQGTLVTISS

SEQ ID NO: 170 - protein, 113 aa, Artificial Sequence
  Description of Artificial Sequence: Synthetic polypeptide
DPDMTQTPSSVSAAVGGTVTINCQASQSVYDNKVLAWYRQKPGQPPKLLIYKASTLASGVPSRFKGRGSGTQFTLTISGVQADDAATYYCLGEFSCSSADCHAFGGGTELEIL

SEQ ID NO: 171 - protein, 6 aa, Artificial Sequence
  Description of Artificial Sequence: Synthetic peptide
STFAMT

SEQ ID NO: 172 - protein, 16 aa, Artificial Sequence
  Description of Artificial Sequence: Synthetic peptide
IINTGGSAYYTSWAKG

SEQ ID NO: 173 - protein, 9 aa, Artificial Sequence
  Description of Artificial Sequence: Synthetic peptide
GDWSSATDL

SEQ ID NO: 174 - protein, 13 aa, Artificial Sequence
  Description of Artificial Sequence: Synthetic peptide
QASQSVYDNKVLA

SEQ ID NO: 175 - protein, 7 aa, Artificial Sequence
  Description of Artificial Sequence: Synthetic peptide
KASTLAS

SEQ ID NO: 176 - protein, 13 aa, Artificial Sequence
  Description of Artificial Sequence: Synthetic peptide
LGEFSCSSADCHA

SEQ ID NO: 177 - protein, 249 aa, Artificial Sequence
  Description of Artificial Sequence: Synthetic polypeptide
QSVKESGGRLVTPGTPLTLTCTASGFTISSSAISWVRQAPGKGLEYIGIIRSGGTTDYASWAKGRFAISKTSTTVDLKITSPTTEDTATYFCARDPPYITSTYFDLWGQGTLVTVSSGGGGSGGGGSGGGGSGGGGASELVLTQPQSVSGSLGQTVSISCKRARDSVESYDVHWYQQHPGKTPTIVIYKDDQRPSGVPDRFSGSIDSTSNSASLTITGLLAEDEADYFCQSFDGDAVVFGGGTQLTVTG

SEQ ID NO: 178 - protein, 117 aa, Artificial Sequence
  Description of Artificial Sequence: Synthetic polypeptide
QSVKESGGRLVTPGTPLTLTCTASGFTISSSAISWVRQAPGKGLEYIGIIRSGGTTDYASWAKGRFAISKTSTTVDLKITSPTTEDTATYFCARDPPYITSTYFDLWGQGTLVTVSS

SEQ ID NO: 179 - protein, 111 aa, Artificial Sequence
  Description of Artificial Sequence: Synthetic polypeptide
ELVLTQPQSVSGSLGQTVSISCKRARDSVESYDVHWYQQHPGKTPTIVIYKDDQRPSGVPDRFSGSIDSTSNSASLTITGLLAEDEADYFCQSFDGDAVVFGGGTQLTVTG

SEQ ID NO: 180 - protein, 6 aa, Artificial Sequence
  Description of Artificial Sequence: Synthetic peptide
SSSAIS

SEQ ID NO: 181 - protein, 16 aa, Artificial Sequence
  Description of Artificial Sequence: Synthetic peptide
IIRSGGTTDYASWAKG

SEQ ID NO: 182 - protein, 12 aa, Artificial Sequence
  Description of Artificial Sequence: Synthetic peptide
DPPYITSTYFDL

SEQ ID NO: 183 - protein, 13 aa, Artificial Sequence
  Description of Artificial Sequence: Synthetic peptide
KRARDSVESYDVH

SEQ ID NO: 184 - protein, 8 aa, Artificial Sequence
  Description of Artificial Sequence: Synthetic peptide
KDDQRPSG

SEQ ID NO: 185 - protein, 9 aa, Artificial Sequence
  Description of Artificial Sequence: Synthetic peptide
QSFDGDAVV

SEQ ID NO: 186 - protein, 107 aa, Homo sapiens [sequence omitted]

SEQ ID NO: 187 - protein, 103 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 188 - protein, 5 aa, Artificial Sequence
  Description of Artificial Sequence: Synthetic peptide
GGGGS

SEQ ID NO: 189 - protein, 254 aa, Artificial Sequence
  Description of Artificial Sequence: Synthetic polypeptide
AVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGGSGGGGSGGGGSGGGGSEVQLVESGGGSVQPGGSLRLSCAASGFTFSTYAMNWVRQAPGKGLEWVGRIRSKANNYATYYADSVKGRFTISRDDSKNTLYLQMNSLRAEDTATYYCVRHGNFGDSYVSWFAYWGQGTTVTVSS

SEQ ID NO: 190 - protein, 130 aa, Artificial Sequence
  Description of Artificial Sequence: Synthetic polypeptide
MEVQLVESGGGLVQAGGSLRVSCAASGLTFSNYAMGWFQQAPGKEREFVAGISWSGVSTYYADFVKGRFTISRDNAKNTVYLQMNSLKPEDTAVYYCAADNRRYSRGTSISTWRSDYDYWGQGTQVTVSS

SEQ ID NO: 191 - protein, 6 aa, Artificial Sequence
  Description of Artificial Sequence: Synthetic peptide
SNYAMG

SEQ ID NO: 192 - protein, 17 aa, Artificial Sequence
  Description of Artificial Sequence: Synthetic peptide
GISWSGVSTYYADFVKG

SEQ ID NO: 193 - protein, 20 aa, Artificial Sequence
  Description of Artificial Sequence: Synthetic peptide
DNRRYSRGTSISTWRSDYDY

SEQ ID NO: 194 - protein, 126 aa, Artificial Sequence
  Description of Artificial Sequence: Synthetic polypeptide
MEVQLVESGGGLVQAGGSLRLSCAASGLTFRRYTMGWFRQAPGKEREFVAAIVSSDSTNYADSVKGRFTISRDNAKNTVYLEMNSLKPDDTCVYYCAARNSLSLYVSNLGSRYDYWGQGTQVTVSS

SEQ ID NO: 195 - protein, 6 aa, Artificial Sequence
  Description of Artificial Sequence: Synthetic peptide
RRYTMG

SEQ ID NO: 196 - protein, 16 aa, Artificial Sequence
  Description of Artificial Sequence: Synthetic peptide
AIVSSDSTNYADSVKG

SEQ ID NO: 197 - protein, 17 aa, Artificial Sequence
  Description of Artificial Sequence: Synthetic peptide
RNSLSLYVSNLGSRYDY

SEQ ID NO: 198 - protein, 127 aa, Artificial Sequence
  Description of Artificial Sequence: Synthetic polypeptide
MEVQLVESGGGLVQAGGSLRLSCTVSGRTSSAFAMGWFRQAPGKEREFVAAINLTGGTTNYAESVKGRFTISRDNAKNTGYLGMSSLKPEDTAVYYCAGRNRWSEGREVAPSSYYYWGQGTQVTVSS

SEQ ID NO: 199 - protein, 6 aa, Artificial Sequence
  Description of Artificial Sequence: Synthetic peptide
SAFAMG

SEQ ID NO: 200 - protein, 17 aa, Artificial Sequence
  Description of Artificial Sequence: Synthetic peptide
AINLTGGTTNYAESVKG

SEQ ID NO: 201 - protein, 17 aa, Artificial Sequence
  Description of Artificial Sequence: Synthetic peptide
RNRWSEGREVAPSSYYY

SEQ ID NO: 202 - protein, 128 aa, Artificial Sequence
  Description of Artificial Sequence: Synthetic polypeptide
MEVQLVESGGGLVQRGDSRRLSCAASGRPFSSFAMGWFRQAPGKEREFVAGISRSAGNTDYSDSVKGRFTISRDNAKNTVYLELNNLTPEDTAVYYCAAQIAIGTGSVFQSNTQYMYWGQGIQVTVSS

SEQ ID NO: 203 - protein, 6 aa, Artificial Sequence
  Description of Artificial Sequence: Synthetic peptide
SSFAMG

SEQ ID NO: 204 - protein, 18 aa, Artificial Sequence
  Description of Artificial Sequence: Synthetic peptide
QIAIGTGSVFQSNTQYMY

SEQ ID NO: 205 - protein, 126 aa, Artificial Sequence
  Description of Artificial Sequence: Synthetic polypeptide
MEVQLVESGGGLVEAGVSLRLSCAASGRTSENFAMGWFRQAPGNEREFVAAITRNHRTFYKESVKDRFTISRDDAKNTVYLEMNNLVPDDTAVYTCAAKFDPYASASSYYTGYYYWGQGTQVTVSS

SEQ ID NO: 206 - protein, 6 aa, Artificial Sequence
  Description of Artificial Sequence: Synthetic peptide
ENFAMG

SEQ ID NO: 207 - protein, 16 aa, Artificial Sequence
  Description of Artificial Sequence: Synthetic peptide
AITRNHRTFYKESVKD

SEQ ID NO: 208 - protein, 17 aa, Artificial Sequence
  Description of Artificial Sequence: Synthetic peptide
KFDPYASASSYYTGYYY

SEQ ID NO: 209 - protein, 113 aa, Artificial Sequence
  Description of Artificial Sequence: Synthetic polypeptide
MEVQLVESGGGSVQPGGSLRLSCAASGFTFSRSTMSWVRQAPGKGLEWVSSISGSGGVTTYTTSVKGRFTISRDNAKNLMYLQMNSLNPEDTAVYYCANGDNRGPGTQVTVSS

SEQ ID NO: 210 - protein, 6 aa, Artificial Sequence
  Description of Artificial Sequence: Synthetic peptide
SRSTMS

SEQ ID NO: 211 - protein, 17 aa, Artificial Sequence
  Description of Artificial Sequence: Synthetic peptide
SISGSGGVTTYTTSVKG

SEQ ID NO: 212 - protein, 3 aa, Artificial Sequence
  Description of Artificial Sequence: Synthetic peptide
GDN

SEQ ID NO: 213 - protein, 113 aa, Artificial Sequence
  Description of Artificial Sequence: Synthetic polypeptide
MEVQLVESGGGLVQPGGSLRLSCLASGFPFSMYTMNWVRQAPGKGLEWVSAISSGGAVTTYADSVKGRFTISRDNAKNTLYLQMSSLKPEDTAVYYCESSNNRGQGTQVTVSS

SEQ ID NO: 214 - protein, 6 aa, Artificial Sequence
  Description of Artificial Sequence: Synthetic peptide
SMYTMN

SEQ ID NO: 215 - protein, 17 aa, Artificial Sequence
  Description of Artificial Sequence: Synthetic peptide
AISSGGAVTTYADSVKG

SEQ ID NO: 216 - protein, 3 aa, Artificial Sequence
  Description of Artificial Sequence: Synthetic peptide
SNN

SEQ ID NO: 217 - protein, 128 aa, Artificial Sequence
  Description of Artificial Sequence: Synthetic polypeptide
MEVQLVESGGGAVQAGGSQRLSCTVSGRPFTKYAMGWFRQPPEKEREFVATSTWEGSTYYADSVKGRFTISRDNANNIIDLQMNTLKPEDTAVYFCAASNTYNADTTYYAKSTAFNFWGQGTQVTVSS

SEQ ID NO: 218 - protein, 6 aa, Artificial Sequence
  Description of Artificial Sequence: Synthetic peptide
TKYAMG

SEQ ID NO: 219 - protein, 16 aa, Artificial Sequence
  Description of Artificial Sequence: Synthetic peptide
TSTWEGSTYYADSVKG

SEQ ID NO: 220 - protein, 19 aa, Artificial Sequence
  Description of Artificial Sequence: Synthetic peptide
SNTYNADTTYYAKSTAFNF

SEQ ID NO: 221 - protein, 113 aa, Artificial Sequence
  Description of Artificial Sequence: Synthetic polypeptide
MEVQLVESGGGLVQPRGSLRLSCAASGFTFSNSGMSWVRQAPGKGLEWVSSISSGGSSTTYLDSVKGRFTISRDNAKNTLYLQMNSLKPEDTAVYYCSWADLRGRGTQVTVSS

SEQ ID NO: 222 - protein, 6 aa, Artificial Sequence
  Description of Artificial Sequence: Synthetic peptide
SNSGMS

SEQ ID NO: 223 - protein, 17 aa, Artificial Sequence
  Description of Artificial Sequence: Synthetic peptide
SISSGGSSTTYLDSVKG

SEQ ID NO: 224 - protein, 3 aa, Artificial Sequence
  Description of Artificial Sequence: Synthetic peptide
ADL

SEQ ID NO: 225 - protein, 113 aa, Artificial Sequence
  Description of Artificial Sequence: Synthetic polypeptide
MEVQLVESGGGLVQPGGSLRLSCVASGFTFSWYTMNWVRQAPGKGFEWVASIGSGGTPTTYRESVKGRFTISRDNAKSTLYLQMNSLKPEDTAVYHCENGQARGQGTQVTVSS

SEQ ID NO: 226 - protein, 6 aa, Artificial Sequence
  Description of Artificial Sequence: Synthetic peptide
SWYTMN

SEQ ID NO: 227 - protein, 17 aa, Artificial Sequence
  Description of Artificial Sequence: Synthetic peptide
SIGSGGTPTTYRESVKG

SEQ ID NO: 228 - protein, 3 aa, Artificial Sequence
  Description of Artificial Sequence: Synthetic peptide
GQA

SEQ ID NO: 229 - protein, 124 aa, Artificial Sequence
  Description of Artificial Sequence: Synthetic polypeptide
MEVQLVESGGGLVQPGGSLRLSCAASGSIFSINDMDWYRQAPGKQRELVAAITRGGSTNYADSVKGRFTISRDNAKNTVYLQMNSLKPEDTAVYYCNAEVSTETTGWRTWRDYWGQGTQVTVSS

SEQ ID NO: 230 - protein, 6 aa, Artificial Sequence
  Description of Artificial Sequence: Synthetic peptide
SINDMD

SEQ ID NO: 231 - protein, 16 aa, Artificial Sequence
  Description of Artificial Sequence: Synthetic peptide
AITRGGSTNYADSVKG

SEQ ID NO: 232 - protein, 15 aa, Artificial Sequence
  Description of Artificial Sequence: Synthetic peptide
EVSTETTGWRTWRDY

SEQ ID NO: 233 - protein, 118 aa, Artificial Sequence
  Description of Artificial Sequence: Synthetic polypeptide
MEVQLVESGGGLVQAGGSLRLSCAVSGRRVSIYGMGWYRLAPGKQREMVASITSGGITTYADSVKGRFSISRDNAKNTVYLQMNSLKPEDTAVYYCNYHDYRVQGESWGQGTQVTVSS

SEQ ID NO: 234 - protein, 6 aa, Artificial Sequence
  Description of Artificial Sequence: Synthetic peptide
SIYGMG

SEQ ID NO: 235 - protein, 16 aa, Artificial Sequence
  Description of Artificial Sequence: Synthetic peptide
SITSGGITTYADSVKG

SEQ ID NO: 236 - protein, 9 aa, Artificial Sequence
  Description of Artificial Sequence: Synthetic peptide
HDYRVQGES

SEQ ID NO: 237 - protein, 131 aa, Artificial Sequence
  Description of Artificial Sequence: Synthetic polypeptide
MEVQLVESGGGLVQAGGSLRLSCAASGRTFSNNAMGWFRQGPDQEREFVAAISRSGGGSGGAPLYADSVKGRFTISRDNAKNTMSLSMNSLSPEDTAVYYCAARSLYKVAGSDDLSDYAYWGQGTQVTVSS

SEQ ID NO: 238 - protein, 6 aa, Artificial Sequence
  Description of Artificial Sequence: Synthetic peptide
SNNAMG

SEQ ID NO: 239 - protein, 21 aa, Artificial Sequence
  Description of Artificial Sequence: Synthetic peptide
AISRSGGGSGGAPLYADSVKG

SEQ ID NO: 240 - protein, 17 aa, Artificial Sequence
  Description of Artificial Sequence: Synthetic peptide
RSLYKVAGSDDLSDYAY

SEQ ID NO: 241 - protein, 129 aa, Artificial Sequence
  Description of Artificial Sequence: Synthetic polypeptide
MEVQLVESGGGLAQAGGSLRVSCVASGRPFTKYAWGWFRQAPGKAREFVATITWDGGKTDYADSVKGRFTISKDSAENSIYLQMNSLKPEDTAVYYCAADRNYCVGHRCYVRPDDYDYWGQGTQVTVSS

SEQ ID NO: 242 - protein, 6 aa, Artificial Sequence
  Description of Artificial Sequence: Synthetic peptide
TKYAWG

SEQ ID NO: 243 - protein, 17 aa, Artificial Sequence
  Description of Artificial Sequence: Synthetic peptide
TITWDGGKTDYADSVKG

SEQ ID NO: 244 - protein, 12 aa, Artificial Sequence
  Description of Artificial Sequence: Synthetic peptide
HRCYVRPDDYDY

SEQ ID NO: 245 - protein, 129 aa, Artificial Sequence
  Description of Artificial Sequence: Synthetic polypeptide
MEVQLVESGGGAVQAGGSLRLSCTVSGRPFTKYAWGWFRQPPEKEREFVATSTWDVGSTYYADSAKGRFTISRDNANNIIDLQMNSLKPEDTAVYYCAASNTYSSDITYYAKPMAFNFWGQGTQVTVSS

SEQ ID NO: 246 - protein, 6 aa, Artificial Sequence
  Description of Artificial Sequence: Synthetic peptide
TKYAWG

SEQ ID NO: 247 - protein, 17 aa, Artificial Sequence
  Description of Artificial Sequence: Synthetic peptide
TSTWDVGSTYYADSAKG

SEQ ID NO: 248 - protein, 19 aa, Artificial Sequence
  Description of Artificial Sequence: Synthetic peptide
SNTYSSDITYYAKPMAFNF

SEQ ID NO: 249 - protein, 113 aa, Artificial Sequence
  Description of Artificial Sequence: Synthetic polypeptide
MEVQLVESGGGSVQPGGSLRLSCAASGFTFSRSTMSWVRQAPGKEIEWVSSVSGSGGVTTYADSVKGRFTISRDNAKNTLYLQMSSLKPEDTAVYYCGNSNARGQGTQVTVSS

SEQ ID NO: 250 - protein, 6 aa, Artificial Sequence
  Description of Artificial Sequence: Synthetic peptide
SRSTMS

SEQ ID NO: 251 - protein, 17 aa, Artificial Sequence
  Description of Artificial Sequence: Synthetic peptide
SVSGSGGVTTYADSVKG

SEQ ID NO: 252 - protein, 3 aa, Artificial Sequence
  Description of Artificial Sequence: Synthetic peptide
SNA

SEQ ID NO: 253 - protein, 113 aa, Artificial Sequence
  Description of Artificial Sequence: Synthetic polypeptide
MEVQLVESGGGLVQPGGSLRLSCAASGFTFSRYTMSWVRQAPGEGLEWVSSIGSGGGPTTYANSVKGRFTVSRDNAKNTLWLQMNNLKPEDTALYYCQGGGNRGQGAQVTVSS

SEQ ID NO: 254 - protein, 6 aa, Artificial Sequence
  Description of Artificial Sequence: Synthetic peptide
SRYTMS

SEQ ID NO: 255 - protein, 17 aa, Artificial Sequence
  Description of Artificial Sequence: Synthetic peptide
SIGSGGGPTTYANSVKG

SEQ ID NO: 256 - protein, 3 aa, Artificial Sequence
  Description of Artificial Sequence: Synthetic peptide
GGN

SEQ ID NO: 257 - protein, 114 aa, Artificial Sequence
  Description of Artificial Sequence: Synthetic polypeptide
MEVQLVESGGGLVQPGGSLRLSCAASGFSFRLYTMSWVRQAPGKGLEWVSSISSGGGVVTTYADSAKGRFTISRDNDKNTLTLQMNSLKPEDTAVYYCAQGERRGQGTQVTVSS

SEQ ID NO: 258 - protein, 6 aa, Artificial Sequence
  Description of Artificial Sequence: Synthetic peptide
RLYTMS

SEQ ID NO: 259 - protein, 18 aa, Artificial Sequence
  Description of Artificial Sequence: Synthetic peptide
SISSGGGVVTTYADSAKG

SEQ ID NO: 260 - protein, 3 aa, Artificial Sequence
  Description of Artificial Sequence: Synthetic peptide
GER

SEQ ID NO: 261 - protein, 113 aa, Artificial Sequence
  Description of Artificial Sequence: Synthetic polypeptide
MEVQLVESGGGLVQPGGSLRLSCAASGFTFSNYGMSWVRQAPGKGLEWVSSIGSGGRITTYLDSVKGRFTISRDNAKNTLYLQMNSLKSEDTAVYYCESGGYRGQGTQVTVSS

SEQ ID NO: 262 - protein, 6 aa, Artificial Sequence
  Description of Artificial Sequence: Synthetic peptide
SNYGMS

SEQ ID NO: 263 - protein, 17 aa, Artificial Sequence
  Description of Artificial Sequence: Synthetic peptide
SIGSGGRITTYLDSVKG

SEQ ID NO: 264 - protein, 3 aa, Artificial Sequence
  Description of Artificial Sequence: Synthetic peptide
GGY

SEQ ID NO: 265 - protein, 224 aa, Artificial Sequence
  Description of Artificial Sequence: Synthetic polypeptide
QEQLVESGGGLVTPGTPLTLTCTVSGFSLSSYAMGWVRQAPGKGLEWIGTINDGGTAFYASWVKGRFTISRTSTTVDLRVTSPTTEDTATYFCARAYGSNGDVYWGYFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 266 - protein, 219 aa, Artificial Sequence
  Description of Artificial Sequence: Synthetic polypeptide
ASELDLTQTPASVEVAVGGTVTIKCQASQSIGSYLSWYQQKPGQRPKLLIFRASTLASGVSSRFKGSGSGTQFTLTISGVECADAATYYCQQGYSSTNLDNVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 267 - protein, 121 aa, Artificial Sequence; identical to SEQ ID NO: 17
  Description of Artificial Sequence: Synthetic polypeptide

SEQ ID NO: 268 - protein, 112 aa, Artificial Sequence
  Description of Artificial Sequence: Synthetic polypeptide
ASELDLTQTPASVEVAVGGTVTIKCQASQSIGSYLSWYQQKPGQRPKLLIFRASTLASGVSSRFKGSGSGTQFTLTISGVECADAATYYCQQGYSSTNLDNVFGGGTEVVVK

SEQ ID NO: 269 - protein, 224 aa, Artificial Sequence
  Description of Artificial Sequence: Synthetic polypeptide
QEQLEESGGGLVTPGGTLTLTCTVSGFSLSNYAMGWVRQAPGKGLEWIGTINDGGTAFYAKWLKGRFTISRTSTTVDLKITSPTTEDTATYFCARAYGSNGDVYWGYFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 270 - protein, 219 aa, Artificial Sequence
  Description of Artificial Sequence: Synthetic polypeptide
ASELVMTQTPSSVSEPVGGTVTIKCQASQSIGSNLAWYQQRPGQPPKLLIYSASTLASGVSSRFKGSGSGTESTLTISGVQAADAATYYCQQGYSSSNVDNVFGGGTELEILRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 271 - protein, 121 aa, Artificial Sequence
  Description of Artificial Sequence: Synthetic polypeptide
QEQLEESGGGLVTPGGTLTLTCTVSGFSLSNYAMGWVRQAPGKGLEWIGTINDGGTAFYAKWLKGRFTISRTSTTVDLKITSPTTEDTATYFCARAYGSNGDVYWGYFNLWGQGTLVTVSS

SEQ ID NO: 272 - protein, 112 aa, Artificial Sequence
  Description of Artificial Sequence: Synthetic polypeptide
ASELVMTQTPSSVSEPVGGTVTIKCQASQSIGSNLAWYQQRPGQPPKLLIYSASTLASGVSSRFKGSGSGTESTLTISGVQAADAATYYCQQGYSSSNVDNVFGGGTELEIL

SEQ ID NO: 273 - protein, 224 aa, Artificial Sequence
  Description of Artificial Sequence: Synthetic polypeptide
QEQLEESGGGLVTPGTPLTLTCTASGFSLSSYAMIWVRQAPGKGLEWIGTINDGGTAFYANWVKGRFTISRTSTTVDLKMTSPTTEDTATYFCARAYGSNGDVYWGYVNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 274 - protein, 219 aa, Artificial Sequence
  Description of Artificial Sequence: Synthetic polypeptide
ASELVMTQTPASVSEPVGGTVTIKCQASQSIGSNLAWYQQKPGQPPKLLIYAAANLASGVSSRFKGSRSGTEYTLTISGVQAADAATYYCQQGYSSSNVANVFGGGTELEILRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 275 - protein, 121 aa, Artificial Sequence; identical to SEQ ID NO: 35
  Description of Artificial Sequence: Synthetic polypeptide

SEQ ID NO: 276 - protein, 112 aa, Artificial Sequence
  Description of Artificial Sequence: Synthetic polypeptide
ASELVMTQTPASVSEPVGGTVTIKCQASQSIGSNLAWYQQKPGQPPKLLIYAAANLASGVSSRFKGSRSGTEYTLTISGVQAADAATYYCQQGYSSSNVANVFGGGTELEIL

SEQ ID NO: 277 - protein, 224 aa, Artificial Sequence
  Description of Artificial Sequence: Synthetic polypeptide
QEQLEESGGGLVTPGTPLTLTCTASGFSLSSYAMIWVRQAPGKGLEWIGTINDGGTAFYASWVKGRFTISRTSTTVDLKITSPTTEDTATYFCARAYGSNGDVYWGYVNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 278 - protein, 219 aa, Artificial Sequence
  Description of Artificial Sequence: Synthetic polypeptide
ASELVMTQTPSSVSAAVGGTVTINCQASQNIGSVFAWYQQKPGQPPKLLIYKASSLASGVPSRFKGSGSGTQFTLTISGVEAADAATYYCQQGASSSNVDNIFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 279 - protein, 121 aa, Artificial Sequence
  Description of Artificial Sequence: Synthetic polypeptide
QEQLEESGGGLVTPGTPLTLTCTASGFSLSSYAMIWVRQAPGKGLEWIGTINDGGTAFYASWVKGRFTISRTSTTVDLKITSPTTEDTATYFCARAYGSNGDVYWGYVNLWGQGTLVTVSS

SEQ ID NO: 280 - protein, 112 aa, Artificial Sequence
  Description of Artificial Sequence: Synthetic polypeptide
ASELVMTQTPSSVSAAVGGTVTINCQASQNIGSVFAWYQQKPGQPPKLLIYKASSLASGVPSRFKGSGSGTQFTLTISGVEAADAATYYCQQGASSSNVDNIFGGGTEVVVK

SEQ ID NO: 281 - protein, 224 aa, Artificial Sequence
  Description of Artificial Sequence: Synthetic polypeptide
QQQLEESGGGLVTPGTPLTLTCTVSGIDLSSYAMGWVRQAPGKGLEWIGTINDGGSAFYASWVKGRFTISRTSTTVDLKITSPTAEDTATYFCAKTYGTNGDVYWGYFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 282 - protein, 219 aa, Artificial Sequence
  Description of Artificial Sequence: Synthetic polypeptide
ASELVMTQTPASVSEPVGGTVTIKCQASQSIGSNLAWYQQKPGQPPKLLIYYESILASGVPSRFSGSGSGTEYTLTISGAQADDAATYYCQQGYSSSNIDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 283 - protein, 121 aa, Artificial Sequence
  Description of Artificial Sequence: Synthetic polypeptide
QQQLEESGGGLVTPGTPLTLTCTVSGIDLSSYAMGWVRQAPGKGLEWIGTINDGGSAFYASWVKGRFTISRTSTTVDLKITSPTAEDTATYFCAKTYGTNGDVYWGYFNLWGQGTLVTVSS

SEQ ID NO: 284 - protein, 112 aa, Artificial Sequence
  Description of Artificial Sequence: Synthetic polypeptide
ASELVMTQTPASVSEPVGGTVTIKCQASQSIGSNLAWYQQKPGQPPKLLIYYESILASGVPSRFSGSGSGTEYTLTISGAQADDAATYYCQQGYSSSNIDNAFGGGTEVVVK

SEQ ID NO: 285 - protein, 222 aa, Artificial Sequence
  Description of Artificial Sequence: Synthetic polypeptide
QQQLVESGGRLVTPGTPLTLTCTASGIDLNSNAMSWVRQGPGKGLEWIGDIWSGGYTDYASWAKGRFTISKTSTTVDLKMTSLTAADTATYFCARDRLAGDGVVDYDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 286 - protein, 219 aa, Artificial Sequence
  Description of Artificial Sequence: Synthetic polypeptide
ASELDMTQTPASVEVAVGGTVTIKCQASQNIYSNLAWYQQKPGQRPKLLIYGASTLASGVPSRFKGSGSGTEYTLTINGVQAADAATYYCQQGFSSSNVDNVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 287 - protein, 119 aa, Artificial Sequence
  Description of Artificial Sequence: Synthetic polypeptide
QQQLVESGGRLVTPGTPLTLTCTASGIDLNSNAMSWVRQGPGKGLEWIGDIWSGGYTDYASWAKGRFTISKTSTTVDLKMTSLTAADTATYFCARDRLAGDGVVDYDLWGQGTLVTVSS

SEQ ID NO: 288 - protein, 112 aa, Artificial Sequence
  Description of Artificial Sequence: Synthetic polypeptide
ASELDMTQTPASVEVAVGGTVTIKCQASQNIYSNLAWYQQKPGQRPKLLIYGASTLASGVPSRFKGSGSGTEYTLTINGVQAADAATYYCQQGFSSSNVDNVFGGGTEVVVK

SEQ ID NO: 289 - protein, 224 aa, Artificial Sequence
  Description of Artificial Sequence: Synthetic polypeptide
QQQLEESGGGLVTPGTPLTLTCTVSGFSLSNYAMGWVRQAPGKGLEWIGTINDGGTAFYANWLKGRFTISRTSTTVDLKITSPTTEDTATYFCARAYGSNGDVYWGYFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 290 - protein, 220 aa, Artificial Sequence
  Description of Artificial Sequence: Synthetic polypeptide
ASELVMTQTASPVSAAVGGTVTINCQASQSISSRSLSWYQQKPGQPPKLLIYEASKLASGVPSRFSGSGSGTQFTLTISGVQADDAATYYCQQGYSSSNVDNVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 291 - protein, 121 aa, Artificial Sequence; identical to SEQ ID NO: 53
  Description of Artificial Sequence: Synthetic polypeptide

SEQ ID NO: 292 - protein, 113 aa, Artificial Sequence
  Description of Artificial Sequence: Synthetic polypeptide
ASELVMTQTASPVSAAVGGTVTINCQASQSISSRSLSWYQQKPGQPPKLLIYEASKLASGVPSRFSGSGSGTQFTLTISGVQADDAATYYCQQGYSSSNVDNVFGGGTEVVVK

SEQ ID NO: 293 - protein, 224 aa, Artificial Sequence; identical to SEQ ID NO: 281
  Description of Artificial Sequence: Synthetic polypeptide

SEQ ID NO: 294 - protein, 219 aa, Artificial Sequence
  Description of Artificial Sequence: Synthetic polypeptide
ASELVMTQTPASVSEPVGGTVTIKCQASQSIGSNLAWYQQKPGQPPKLLIYYESILASGVPSRFSGSGSGTEYTLTISGAQADDAATYYCQQGYSSSNILNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 295 - protein, 121 aa, Artificial Sequence; identical to SEQ ID NO: 283
  Description of Artificial Sequence: Synthetic polypeptide

SEQ ID NO: 296 - protein, 112 aa, Artificial Sequence
  Description of Artificial Sequence: Synthetic polypeptide
ASELVMTQTPASVSEPVGGTVTIKCQASQSIGSNLAWYQQKPGQPPKLLIYYESILASGVPSRFSGSGSGTEYTLTISGAQADDAATYYCQQGYSSSNILNAFGGGTEVVVK

SEQ ID NO: 297 - protein, 222 aa, Artificial Sequence
  Description of Artificial Sequence: Synthetic polypeptide
QSVEESGGRLVTPGTPLTLTCTVSGFSLSNYAMSWVRQAPGKGLEYIGIVSSGGTTYYASWAKGRFTISKTSTTVDLKITSPTTEDTATYFCAKDLYYGPTTYSAFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 298 - protein, 221 aa, Artificial Sequence
  Description of Artificial Sequence: Synthetic polypeptide
ASELVLTQPQSVSGSLGQTVSISCKRARNNIEDYYVHWYQQHPGRSPTIVIHKDDQRPSGVPDRFSGSIDSTSNSASLTITGLLAEDEADYFCQSFDNNANPVFGGGTQLTVTGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - protein, 119 aa, Artificial Sequence; identical to SEQ ID NO: 106
  Description of Artificial Sequence: Synthetic polypeptide

SEQ ID NO: 300 - protein, 114 aa, Artificial Sequence
  Description of Artificial Sequence: Synthetic polypeptide
ASELVLTQPQSVSGSLGQTVSISCKRARNNIEDYYVHWYQQHPGRSPTIVIHKDDQRPSGVPDRFSGSIDSTSNSASLTITGLLAEDEADYFCQSFDNNANPVFGGGTQLTVTG

SEQ ID NO: 301 - protein, 222 aa, Artificial Sequence
  Description of Artificial Sequence: Synthetic polypeptide
QSVKESGGRLVTPGTPLTLTCTVSGFSLSNYAMSWVRQAPGKGLEYIGIVSSGGTTYYASWAKGRFTISKTSTTVDLKITSPTTEDTATYFCAKDLYYGPTTYSAFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 302 - protein, 221 aa, Artificial Sequence
  Description of Artificial Sequence: Synthetic polypeptide
ASELVLTQPQSVSGSLGQTVSISCKRARDNIEDYYVHWYQQHPGKTPTIVIHKDDQRPSGVPDRFSGSIDSTSNSASLTITGLLAEDEADYFCQSFDNDASPVFGGGTQLTVTGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 303 - protein, 119 aa, Artificial Sequence
  Description of Artificial Sequence: Synthetic polypeptide
QSVKESGGRLVTPGTPLTLTCTVSGFSLSNYAMSWVRQAPGKGLEYIGIVSSGGTTYYASWAKGRFTISKTSTTVDLKITSPTTEDTATYFCAKDLYYGPTTYSAFNLWGQGTLVTVSS

SEQ ID NO: 304 - protein, 114 aa, Artificial Sequence
  Description of Artificial Sequence: Synthetic polypeptide
ASELVLTQPQSVSGSLGQTVSISCKRARDNIEDYYVHWYQQHPGKTPTIVIHKDDQRPSGVPDRFSGSIDSTSNSASLTITGLLAEDEADYFCQSFDNDASPVFGGGTQLTVTG

SEQ ID NO: 305 - protein, 222 aa, Artificial Sequence; identical to SEQ ID NO: 301
  Description of Artificial Sequence: Synthetic polypeptide

SEQ ID NO: 306 - protein, 221 aa, Artificial Sequence
  Description of Artificial Sequence: Synthetic polypeptide
ASELVLTQPQSVSGSLGQTVSISCKRARDNIEDYYVHWYQQYPGKTPTIVIYKDDQRPSGVPDRFSGSIDSTSNSASLTITGLLAEDEADYFCQSFDNNANVVFGGGTQLTVTGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 307 - protein, 119 aa, Artificial Sequence; identical to SEQ ID NO: 303
  Description of Artificial Sequence: Synthetic polypeptide

SEQ ID NO: 308 - protein, 114 aa, Artificial Sequence
  Description of Artificial Sequence: Synthetic polypeptide
ASELVLTQPQSVSGSLGQTVSISCKRARDNIEDYYVHWYQQYPGKTPTIVIYKDDQRPSGVPDRFSGSIDSTSNSASLTITGLLAEDEADYFCQSFDNNANVVFGGGTQLTVTG

SEQ ID NO: 309 - protein, 220 aa, Artificial Sequence
  Description of Artificial Sequence: Synthetic polypeptide
QSVKESGGRLVTPGTPLTLTCTASGFTISSSAISWVRQAPGKGLEYIGIIRSGGTTDYASWAKGRFAISKTSTTVDLKITSPTTEDTATYFCARDPPYITSTYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 310 - protein, 220 aa, Artificial Sequence
  Description of Artificial Sequence: Synthetic polypeptide
ASELVLTQPQSVSGSLGQTVSISCKRARDSVESYDVHWYQQHPGKTPTIVIYKDDQRPSGVPDRFSGSIDSTSNSASLTITGLLAEDEADYFCQSFDGDAVVFGGGTQLTVTGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 311 - protein, 117 aa, Artificial Sequence; identical to SEQ ID NO: 178
  Description of Artificial Sequence: Synthetic polypeptide

SEQ ID NO: 312 - protein, 113 aa, Artificial Sequence
  Description of Artificial Sequence: Synthetic polypeptide
ASELVLTQPQSVSGSLGQTVSISCKRARDSVESYDVHWYQQHPGKTPTIVIYKDDQRPSGVPDRFSGSIDSTSNSASLTITGLLAEDEADYFCQSFDGDAVVFGGGTQLTVTG

SEQ ID NO: 313 - protein, 222 aa, Artificial Sequence; identical to SEQ ID NO: 301
  Description of Artificial Sequence: Synthetic polypeptide

SEQ ID NO: 314 - protein, 219 aa, Artificial Sequence
  Description of Artificial Sequence: Synthetic polypeptide
ASELVLTQPASVQVNLGQTVSLTCTADTLSRSYASWYQLKPGQAPVLLIYRDTSRPSGVPDRFSGSSSGNTATLTISGAQAGDEGDYVCATSDGSGSNFQLFGGGTQLTVTGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 315 - protein, 119 aa, Artificial Sequence; identical to SEQ ID NO: 303
  Description of Artificial Sequence: Synthetic polypeptide

SEQ ID NO: 316 - protein, 112 aa, Artificial Sequence
  Description of Artificial Sequence: Synthetic polypeptide
ASELVLTQPASVQVNLGQTVSLTCTADTLSRSYASWYQLKPGQAPVLLIYRDTSRPSGVPDRFSGSSSGNTATLTISGAQAGDEGDYVCATSDGSGSNFQLFGGGTQLTVTG

SEQ ID NO: 317 - protein, 224 aa, Artificial Sequence; identical to SEQ ID NO: 289
  Description of Artificial Sequence: Synthetic polypeptide

SEQ ID NO: 318 - protein, 219 aa, Artificial Sequence
  Description of Artificial Sequence: Synthetic polypeptide
ASELVMTQTASPVSAAVGGTVTINCQASQSISSRSLSWYQQKPGQPPKLLIYEASKLASGVPSRFSGSGSGTQFTLTISGVQADDAATYYCQQGYSSSNVDNFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 319 - protein, 121 aa, Artificial Sequence; identical to SEQ ID NO: 53
  Description of Artificial Sequence: Synthetic polypeptide

SEQ ID NO: 320 - protein, 112 aa, Artificial Sequence
  Description of Artificial Sequence: Synthetic polypeptide
ASELVMTQTASPVSAAVGGTVTINCQASQSISSRSLSWYQQKPGQPPKLLIYEASKLASGVPSRFSGSGSGTQFTLTISGVQADDAATYYCQQGYSSSNVDNFGGGTEVVVK

SEQ ID NO: 321 - protein, 223 aa, Artificial Sequence
  Description of Artificial Sequence: Synthetic polypeptide
QSVKESWGRLVTPGGSLTLTCTVSGIDLNNYAMGWVRQAPGKGLEWIGTINNDGATYYPSWARGRFTISKTSTTVDLKITSPTTEDTATYFCARTYGSNGDVYWGYFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 322 - protein, 219 aa, Artificial Sequence
  Description of Artificial Sequence: Synthetic polypeptide
ASALELTQTPASVEVAVGGTVTINCQASQSIGGALNWYQQKSGQPPKLLIYLASTLASGVSSRFKGSGSGTQFTLTISGVEAADAATYYCQQGYSASNIDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 323 - protein, 120 aa, Artificial Sequence; identical to SEQ ID NO: 71
  Description of Artificial Sequence: Synthetic polypeptide

SEQ ID NO: 324 - protein, 112 aa, Artificial Sequence
  Description of Artificial Sequence: Synthetic polypeptide
ASALELTQTPASVEVAVGGTVTINCQASQSIGGALNWYQQKSGQPPKLLIYLASTLASGVSSRFKGSGSGTQFTLTISGVEAADAATYYCQQGYSASNIDNAFGGGTEVVVK

SEQ ID NO: 325 - protein, 221 aa, Artificial Sequence
  Description of Artificial Sequence: Synthetic polypeptide
PEQLEESGGGLVTPGGVLTLTCTASGFSFSSYGVNWVRQAPGKGLEWIGFIFGDGTTYYANWAKGRFTISKTSTTVDLKMTSPTTEDTATYFCARDGYGGYDYIINLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 326 - protein, 222 aa, Artificial Sequence
  Description of Artificial Sequence: Synthetic polypeptide
ASAQVLTQTPASVSAAVGGTVSISCQSSQSVVNNNWLAWYQQKPGQPPKLLIYKASTLESGVPSRFKGSGSGTQFTLTISGVQADDAATYYCLGEFSCSSADCHAFGGGTELEILRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 327 - protein, 118 aa, Artificial Sequence
  Description of Artificial Sequence: Synthetic polypeptide
PEQLEESGGGLVTPGGVLTLTCTASGFSFSSYGVNWVRQAPGKGLEWIGFIFGDGTTYYANWAKGRFTISKTSTTVDLKMTSPTTEDTATYFCARDGYGGYDYIINLWGQGTLVTVSS

SEQ ID NO: 328 - protein, 115 aa, Artificial Sequence
  Description of Artificial Sequence: Synthetic polypeptide
ASAQVLTQTPASVSAAVGGTVSISCQSSQSVVNNNWLAWYQQKPGQPPKLLIYKASTLESGVPSRFKGSGSGTQFTLTISGVQADDAATYYCLGEFSCSSADCHAFGGGTELEIL

SEQ ID NO: 329 - protein, 221 aa, Artificial Sequence; identical to SEQ ID NO: 325
  Description of Artificial Sequence: Synthetic polypeptide

SEQ ID NO: 330 - protein, 221 aa, Artificial Sequence
  Description of Artificial Sequence: Synthetic polypeptide
ASAQVLTQTPASVSAAVGGTVSISCQSSQSVVNNNWLAWYQQKPGQPPKLLIYKASTLESGVPSRFKGSGSGTQFTLTISGVQADDAATYYCQGAYSGNIYYNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 331 - protein, 118 aa, Artificial Sequence; identical to SEQ ID NO: 327
  Description of Artificial Sequence: Synthetic polypeptide

SEQ ID NO: 332 - protein, 114 aa, Artificial Sequence
  Description of Artificial Sequence: Synthetic polypeptide
ASAQVLTQTPASVSAAVGGTVSISCQSSQSVVNNNWLAWYQQKPGQPPKLLIYKASTLESGVPSRFKGSGSGTQFTLTISGVQADDAATYYCQGAYSGNIYYNAFGGGTEVVVK

SEQ ID NO: 333 - protein, 220 aa, Artificial Sequence
  Description of Artificial Sequence: Synthetic polypeptide
QSVKESGGGLVTPGTPLTLTCTVSGFSLSTYAISWVRQAPGKGLEWIGFIDTVDSAYYASWAKGRFTISKTSSTTVDLKMTSPTTEDTATYFCAKLRYGDYGDYTLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 334 - protein, 216 aa, Artificial Sequence
  Description of Artificial Sequence: Synthetic polypeptide
ASELVMTQTPSPVSGAVGGTVTIKCQASQNIYSYLAWYQQKPGQPPKLLIYKASTLASGVPSRVKGSGSGTEYTLTISGVQAADAATYYCQCTYYDSNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 335 - protein, 117 aa, Artificial Sequence; identical to SEQ ID NO: 160
  Description of Artificial Sequence: Synthetic polypeptide

SEQ ID NO: 336 - protein, 109 aa, Artificial Sequence
  Description of Artificial Sequence: Synthetic polypeptide
ASELVMTQTPSPVSGAVGGTVTIKCQASQNIYSYLAWYQQKPGQPPKLLIYKASTLASGVPSRVKGSGSGTEYTLTISGVQAADAATYYCQCTYYDSNTFGGGTEVVVK

SEQ ID NO: 337 - protein, 218 aa, Artificial Sequence
  Description of Artificial Sequence: Synthetic polypeptide
PAALEESGGRLVTPGTPLTLTCTVSGIDLSTFAMTWVRQAPGKGLEWLGIINTGGSAYYTSWAKGRFTISRTSTTVDLKITSPTTEDTATYFCARGDWSSATDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 338 - protein, 222 aa, Artificial Sequence
  Description of Artificial Sequence: Synthetic polypeptide
ASDPDMTQTPSSVSAAVGGTVTINCQASQSVYDNKVLAWYRQKPGQPPKLLIYKASTLASGVPSRFKGRGSGTQFTLTISGVQADDAATYYCLGEFSCSSADCHAFGGGTELEILRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 339 - protein, 115 aa, Artificial Sequence
  Description of Artificial Sequence: Synthetic polypeptide
PAALEESGGRLVTPGTPLTLTCTVSGIDLSTFAMTWVRQAPGKGLEWLGIINTGGSAYYTSWAKGRFTISRTSTTVDLKITSPTTEDTATYFCARGDWSSATDLWGQGTLVTVSS

SEQ ID NO: 340 - protein, 115 aa, Artificial Sequence
  Description of Artificial Sequence: Synthetic polypeptide
ASDPDMTQTPSSVSAAVGGTVTINCQASQSVYDNKVLAWYRQKPGQPPKLLIYKASTLASGVPSRFKGRGSGTQFTLTISGVQADDAATYYCLGEFSCSSADCHAFGGGTELEIL

SEQ ID NO: 341 - protein, 222 aa, Artificial Sequence; identical to SEQ ID NO: 297
  Description of Artificial Sequence: Synthetic polypeptide

SEQ ID NO: 342 - protein, 480 aa, Artificial Sequence
  Description of Artificial Sequence: Synthetic polypeptide
ASELVLTQPQSVSGSLGQTVSISCKRARNNIEDYYVHWYQQHPGRSPTIVIHKDDQRPSGVPDRFSGSIDSTSNSASLTITGLLAEDEADYFCQSFDNNANPVFGGGTQLTVTGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGGSGGGGSGGGGSGGGGSEVQLVESGGGSVQPGGSLRLSCAASGFTFSTYAMNWVRQAPGKGLEWVGRIRSKANNYATYYADSVKGRFTISRDDSKNTLYLQMNSLRAEDTATYYCVRHGNFGDSYVSWFAYWGQGTTVTVSS

SEQ ID NO: 343 - protein, 228 aa, Artificial Sequence
  Description of Artificial Sequence: Synthetic polypeptide
EVQLVESGGGSVQPGGSLRLSCAASGFTFSTYAMNWVRQAPGKGLEWVGRIRSKANNYATYYADSVKGRFTISRDDSKNTLYLQMNSLRAEDTATYYCVRHGNFGDSYVSWFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 344 - protein, 349 aa, Artificial Sequence
  Description of Artificial Sequence: Synthetic polypeptide
EVQLVESGGGLVQAGGSLRVSCAASGLTFSNYAMGWFQQAPGKEREFVAGISWSGVSTYYADFVKGRFTISRDNAKNTVYLQMNSLKPEDTAVYYCAADNRRYSRGTSISTWRSDYDYWGQGTQVTVSSGGGGSAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 345 - protein, 9 aa, Artificial Sequence
  Description of Artificial Sequence: Synthetic peptide
GVRGRVEEI

SEQ ID NO: 346 - protein, 9 aa, Artificial Sequence
  Description of Artificial Sequence: Synthetic peptide
AVLDGLLSL

SEQ ID NO: 347 - protein, 9 aa, Artificial Sequence
  Description of Artificial Sequence: Synthetic peptide
FLYDDNQRV

SEQ ID NO: 348 - protein, 10 aa, Artificial Sequence
  Description of Artificial Sequence: Synthetic peptide
YMLDLQPETT

SEQ ID NO: 349 - protein, 10 aa, Artificial Sequence
  Description of Artificial Sequence: Synthetic peptide
ELAGIGILTV

SEQ ID NO: 350 - protein, 10 aa, Artificial Sequence
  Description of Artificial Sequence: Synthetic peptide
EAAGIGILTV

SEQ ID NO: 351 - protein, 8 aa, Artificial Sequence
  Description of Artificial Sequence: Synthetic peptide
LLGDLFGV

SEQ ID NO: 352 - protein, 9 aa, Artificial Sequence
  Description of Artificial Sequence: Synthetic peptide
FLWGPRALV

SEQ ID NO: 353 - protein, 9 aa, Artificial Sequence
  Description of Artificial Sequence: Synthetic peptide
SLYNTVATL

SEQ ID NO: 354 - protein, 9 aa, Artificial Sequence
  Description of Artificial Sequence: Synthetic peptide
SLYSYFQKV

SEQ ID NO: 355 - protein, 9 aa, Artificial Sequence
  Description of Artificial Sequence: Synthetic peptide
GLCTLVAML

SEQ ID NO: 356 - protein, 9 aa, Artificial Sequence
  Description of Artificial Sequence: Synthetic peptide
GILGFVFTL

SEQ ID NO: 357 - protein, 9 aa, Artificial Sequence
  Description of Artificial Sequence: Synthetic peptide
VLAGGFFLL

SEQ ID NO: 358 - protein, 9 aa, Artificial Sequence
  Description of Artificial Sequence: Synthetic peptide
FVGEFFTDV

SEQ ID NO: 359 - protein, 9 aa, Artificial Sequence
  Description of Artificial Sequence: Synthetic peptide
FLYALALLL

SEQ ID NO: 360 - protein, 9 aa, Artificial Sequence
  Description of Artificial Sequence: Synthetic peptide
YMDDVVLGV

SEQ ID NO: 361 - protein, 10 aa, Artificial Sequence
  Description of Artificial Sequence: Synthetic peptide
ALLTSRLRFI

SEQ ID NO: 362 - protein, 10 aa, Artificial Sequence
  Description of Artificial Sequence: Synthetic peptide
FLPSDFFPSV

SEQ ID NO: 363 - protein, 9 aa, Artificial Sequence
  Description of Artificial Sequence: Synthetic peptide
KIFGSLAFL

SEQ ID NO: 364 - protein, 9 aa, Artificial Sequence
  Description of Artificial Sequence: Synthetic peptide
SLLMWITQV

SEQ ID NO: 365 - protein, 9 aa, Artificial Sequence
  Description of Artificial Sequence: Synthetic peptide
RMFPNAPYL

SEQ ID NO: 366 - protein, 9 aa, Artificial Sequence
  Description of Artificial Sequence: Synthetic peptide
YMDGTMSQV

SEQ ID NO: 367 - protein, 9 aa, Artificial Sequence
  Description of Artificial Sequence: Synthetic peptide
VLFGLGFAI

SEQ ID NO: 368 - protein, 9 aa, Artificial Sequence
  Description of Artificial Sequence: Synthetic peptide
SLPPPGTRV

SEQ ID NO: 369 - protein, 9 aa, Artificial Sequence
  Description of Artificial Sequence: Synthetic peptide
VLEETSVML

SEQ ID NO: 370 - protein, 9 aa, Artificial Sequence
  Description of Artificial Sequence: Synthetic peptide
RMPEAAPPV

SEQ ID NO: 371 - protein, 9 aa, Artificial Sequence
  Description of Artificial Sequence: Synthetic peptide
ILKEPVHGV

SEQ ID NO: 372 - protein, 9 aa, Artificial Sequence
  Description of Artificial Sequence: Synthetic peptide
KTWGQYWQV

SEQ ID NO: 373 - protein, 9 aa, Artificial Sequence
  Description of Artificial Sequence: Synthetic peptide
SLLPIMWQL

SEQ ID NO: 374 - protein, 9 aa, Artificial Sequence
  Description of Artificial Sequence: Synthetic peptide
NLVPMVATV

SEQ ID NO: 375 - protein, 9 aa, Artificial Sequence
  Description of Artificial Sequence: Synthetic peptide
VLQELNVTV

SEQ ID NO: 376 - protein, 9 aa, Artificial Sequence
  Description of Artificial Sequence: Synthetic peptide
CINGVCWTV

SEQ ID NO: 377 - protein, 9 aa, Artificial Sequence
  Description of Artificial Sequence: Synthetic peptide
LMLGEFLKL

SEQ ID NO: 378 - protein, 9 aa, Artificial Sequence
  Description of Artificial Sequence: Synthetic peptide
VLDFAPPGA

SEQ ID NO: 379 - protein, 9 aa, Artificial Sequence
  Description of Artificial Sequence: Synthetic peptide
LTLGEFLKL

SEQ ID NO: 380 - protein, 9 aa, Artificial Sequence
  Description of Artificial Sequence: Synthetic peptide
IMDQVPFSV

SEQ ID NO: 381 - protein, 9 aa, Artificial Sequence
  Description of Artificial Sequence: Synthetic peptide
CLGGLLTMV

SEQ ID NO: 382 - protein, 9 aa, Artificial Sequence
  Description of Artificial Sequence: Synthetic peptide
VTEHDTLLY

SEQ ID NO: 383 - protein, 9 aa, Artificial Sequence
  Description of Artificial Sequence: Synthetic peptide
FLLTKILTI

SEQ ID NO: 384 - protein, 9 aa, Artificial Sequence
  Description of Artificial Sequence: Synthetic peptide
WLSLLVQFV

SEQ ID NO: 385 - protein, 9 aa, Artificial Sequence
  Description of Artificial Sequence: Synthetic peptide
LLLLTVLTV

SEQ ID NO: 386 - protein, 9 aa, Artificial Sequence
  Description of Artificial Sequence: Synthetic peptide
FLLTRILTI

SEQ ID NO: 387 - protein, 9 aa, Artificial Sequence
  Description of Artificial Sequence: Synthetic peptide
ITDQVPFSV

SEQ ID NO: 388 - protein, 9 aa, Artificial Sequence
  Description of Artificial Sequence: Synthetic peptide
YMCSFLFNL

SEQ ID NO: 389 - protein, 9 aa, Artificial Sequence
  Description of Artificial Sequence: Synthetic peptide
ILSLELMKL

SEQ ID NO: 390 - protein, 9 aa, Artificial Sequence
  Description of Artificial Sequence: Synthetic peptide
YLEYRQVPV

SEQ ID NO: 391 - protein, 9 aa, Artificial Sequence
  Description of Artificial Sequence: Synthetic peptide
RLPLVLPAV

SEQ ID NO: 392 - protein, 9 aa, Artificial Sequence
  Description of Artificial Sequence: Synthetic peptide
KLQVFLIVL

SEQ ID NO: 393 - protein, 9 aa, Artificial Sequence
  Description of Artificial Sequence: Synthetic peptide
YLGSYGFRL

SEQ ID NO: 394 - protein, 10 aa, Artificial Sequence
  Description of Artificial Sequence: Synthetic peptide
GLADGRTHTV

SEQ ID NO: 395 - protein, 10 aa, Artificial Sequence
  Description of Artificial Sequence: Synthetic peptide
GLYDGPVHEV

SEQ ID NO: 396 - protein, 9 aa, Artificial Sequence
  Description of Artificial Sequence: Synthetic peptide
GVFDGLHTV

SEQ ID NO: 397 - protein, 6 aa, Artificial Sequence
  Description of Artificial Sequence: Synthetic peptide
SSYAMG

SEQ ID NO: 398 - protein, 16 aa, Artificial Sequence
  Description of Artificial Sequence: Synthetic peptide
TINDGGTAFYASWVKG

SEQ ID NO: 399 - protein, 15 aa, Artificial Sequence
  Description of Artificial Sequence: Synthetic peptide
AYGSNGDVYWGYFNL

SEQ ID NO: 400 - protein, 11 aa, Artificial Sequence
  Description of Artificial Sequence: Synthetic peptide
QASQSIGSYLS

SEQ ID NO: 401 - protein, 7 aa, Artificial Sequence
  Description of Artificial Sequence: Synthetic peptide
RASTLAS

SEQ ID NO: 402 - protein, 12 aa, Artificial Sequence
  Description of Artificial Sequence: Synthetic peptide
QQGYSSTNLDNV

SEQ ID NO: 403 - protein, 6 aa, Artificial Sequence
  Description of Artificial Sequence: Synthetic peptide
SNYAMG

SEQ ID NO: 404 - protein, 16 aa, Artificial Sequence
  Description of Artificial Sequence: Synthetic peptide
TINDGGTAFYAKWLKG

SEQ ID NO: 405 - protein, 15 aa, Artificial Sequence
  Description of Artificial Sequence: Synthetic peptide
AYGSNGDVYWGYFNL

SEQ ID NO: 406 - protein, 11 aa, Artificial Sequence
  Description of Artificial Sequence: Synthetic peptide
QASQSIGSNLA

SEQ ID NO: 407 - protein, 7 aa, Artificial Sequence
  Description of Artificial Sequence: Synthetic peptide
SASTLAS

SEQ ID NO: 408 - protein, 12 aa, Artificial Sequence
  Description of Artificial Sequence: Synthetic peptide
QQGYSSSNVDNV

SEQ ID NO: 409 - protein, 6 aa, Artificial Sequence
  Description of Artificial Sequence: Synthetic peptide
SSYAMI

SEQ ID NO: 410 - protein, 16 aa, Artificial Sequence
  Description of Artificial Sequence: Synthetic peptide
TINDGGTAFYANWVKG

SEQ ID NO: 411 - protein, 15 aa, Artificial Sequence
  Description of Artificial Sequence: Synthetic peptide
AYGSNGDVYWGYVNL

SEQ ID NO: 412 - protein, 11 aa, Artificial Sequence
  Description of Artificial Sequence: Synthetic peptide
QASQSIGSNLA

SEQ ID NO: 413 - protein, 7 aa, Artificial Sequence
  Description of Artificial Sequence: Synthetic peptide
AAANLAS

SEQ ID NO: 414 - protein, 12 aa, Artificial Sequence
  Description of Artificial Sequence: Synthetic peptide
QQGYSSSNVANV

SEQ ID NO: 415 - protein, 6 aa, Artificial Sequence
  Description of Artificial Sequence: Synthetic peptide
SSYAMI

SEQ ID NO: 416 - protein, 16 aa, Artificial Sequence
  Description of Artificial Sequence: Synthetic peptide
TINDGGTAFYASWVKG

SEQ ID NO: 417 - protein, 15 aa, Artificial Sequence
  Description of Artificial Sequence: Synthetic peptide
AYGSNGDVYWGYVNL

SEQ ID NO: 418 - protein, 11 aa, Artificial Sequence
  Description of Artificial Sequence: Synthetic peptide
QASQNIGSVFA

SEQ ID NO: 419 - protein, 7 aa, Artificial Sequence
  Description of Artificial Sequence: Synthetic peptide
KASSLAS

SEQ ID NO: 420 - protein, 12 aa, Artificial Sequence
  Description of Artificial Sequence: Synthetic peptide
QQGASSSNVDNI

SEQ ID NO: 421 - protein, 6 aa, Artificial Sequence
  Description of Artificial Sequence: Synthetic peptide
SSYAMG

SEQ ID NO: 422 - protein, 16 aa, Artificial Sequence
  Description of Artificial Sequence: Synthetic peptide
TINDGGSAFYASWVKG

SEQ ID NO: 423 - protein, 15 aa, Artificial Sequence
  Description of Artificial Sequence: Synthetic peptide
TYGTNGDVYWGYFNL

SEQ ID NO: 424 - protein, 11 aa, Artificial Sequence
  Description of Artificial Sequence: Synthetic peptide
QASQSIGSNLA

SEQ ID NO: 425 - protein, 7 aa, Artificial Sequence
  Description of Artificial Sequence: Synthetic peptide
YESILAS

SEQ ID NO: 426 - protein, 12 aa, Artificial Sequence
  Description of Artificial Sequence: Synthetic peptide
QQGYSSSNIDNA

SEQ ID NO: 427 - protein, 6 aa, Artificial Sequence
  Description of Artificial Sequence: Synthetic peptide
NSNAMS

SEQ ID NO: 428 - protein, 16 aa, Artificial Sequence
  Description of Artificial Sequence: Synthetic peptide
DIWSGGYTDYASWAKG

SEQ ID NO: 429 - protein, 13 aa, Artificial Sequence
  Description of Artificial Sequence: Synthetic peptide
DRLAGDGVVDYDL

SEQ ID NO: 430 - protein, 11 aa, Artificial Sequence
  Description of Artificial Sequence: Synthetic peptide
QASQNIYSNLA

SEQ ID NO: 431 - protein, 7 aa, Artificial Sequence
  Description of Artificial Sequence: Synthetic peptide
GASTLAS

SEQ ID NO: 432 - protein, 12 aa, Artificial Sequence
  Description of Artificial Sequence: Synthetic peptide
QQGFSSSNVDNV

SEQ ID NO: 433 - protein, 6 aa, Artificial Sequence
  Description of Artificial Sequence: Synthetic peptide
SNYAMG

SEQ ID NO: 434 - protein, 16 aa, Artificial Sequence
  Description of Artificial Sequence: Synthetic peptide
TINDGGTAFYANWLKG

SEQ ID NO: 435 - protein, 15 aa, Artificial Sequence
  Description of Artificial Sequence: Synthetic peptide
AYGSNGDVYWGYFNL

SEQ ID NO: 436 - protein, 12 aa, Artificial Sequence
  Description of Artificial Sequence: Synthetic peptide
QASQSISSRSLS

SEQ ID NO: 437 - protein, 7 aa, Artificial Sequence
  Description of Artificial Sequence: Synthetic peptide
EASKLAS

SEQ ID NO: 438 - protein, 12 aa, Artificial Sequence
  Description of Artificial Sequence: Synthetic peptide
QQGYSSSNVDNV

SEQ ID NO: 439 - protein, 6 aa, Artificial Sequence
  Description of Artificial Sequence: Synthetic peptide
SSYAMG

SEQ ID NO: 440 - protein, 16 aa, Artificial Sequence
  Description of Artificial Sequence: Synthetic peptide
TINDGGSAFYASWVKG

SEQ ID NO: 441 - protein, 15 aa, Artificial Sequence
  Description of Artificial Sequence: Synthetic peptide
TYGTNGDVYWGYFNL

SEQ ID NO: 442 - protein, 11 aa, Artificial Sequence
  Description of Artificial Sequence: Synthetic peptide
QASQSIGSNLA

SEQ ID NO: 443 - protein, 7 aa, Artificial Sequence
  Description of Artificial Sequence: Synthetic peptide
YESILAS

SEQ ID NO: 444 - protein, 12 aa, Artificial Sequence
  Description of Artificial Sequence: Synthetic peptide
QQGYSSSNILNA

SEQ ID NO: 445 - protein, 6 aa, Artificial Sequence
  Description of Artificial Sequence: Synthetic peptide
SNYAMS

SEQ ID NO: 446 - protein, 16 aa, Artificial Sequence
  Description of Artificial Sequence: Synthetic peptide
IVSSGGTTYYASWAKG

SEQ ID NO: 447 - protein, 14 aa, Artificial Sequence
  Description of Artificial Sequence: Synthetic peptide
DLYYGPTTYSAFNL

SEQ ID NO: 448 - protein, 13 aa, Artificial Sequence
  Description of Artificial Sequence: Synthetic peptide
KRARNNIEDYYVH

SEQ ID NO: 449 - protein, 7 aa, Artificial Sequence
  Description of Artificial Sequence: Synthetic peptide
KDDQRPS

SEQ ID NO: 450 - protein, 10 aa, Artificial Sequence
  Description of Artificial Sequence: Synthetic peptide
QSFDNNANPV

SEQ ID NO: 451 - protein, 6 aa, Artificial Sequence
  Description of Artificial Sequence: Synthetic peptide
SNYAMS

SEQ ID NO: 452 - protein, 16 aa, Artificial Sequence
  Description of Artificial Sequence: Synthetic peptide
IVSSGGTTYYASWAKG

SEQ ID NO: 453 - protein, 14 aa, Artificial Sequence
  Description of Artificial Sequence: Synthetic peptide
DLYYGPTTYSAFNL

SEQ ID NO: 454 - protein, 13 aa, Artificial Sequence
  Description of Artificial Sequence: Synthetic peptide
KRARDNIEDYYVH

SEQ ID NO: 455 - protein, 7 aa, Artificial Sequence
  Description of Artificial Sequence: Synthetic peptide
KDDQRPS

SEQ ID NO: 456 - protein, 10 aa, Artificial Sequence
  Description of Artificial Sequence: Synthetic peptide
QSFDNDASPV

SEQ ID NO: 457 - protein, 6 aa, Artificial Sequence
  Description of Artificial Sequence: Synthetic peptide
SNYAMS

SEQ ID NO: 458 - protein, 16 aa, Artificial Sequence
  Description of Artificial Sequence: Synthetic peptide
IVSSGGTTYYASWAKG

SEQ ID NO: 459 - protein, 14 aa, Artificial Sequence
  Description of Artificial Sequence: Synthetic peptide
DLYYGPTTYSAFNL

SEQ ID NO: 460 - protein, 13 aa, Artificial Sequence
  Description of Artificial Sequence: Synthetic peptide
KRARDNIEDYYVH

SEQ ID NO: 461 - protein, 7 aa, Artificial Sequence
  Description of Artificial Sequence: Synthetic peptide
KDDQRPS

SEQ ID NO: 462 - protein, 10 aa, Artificial Sequence
  Description of Artificial Sequence: Synthetic peptide
QSFDNNANVV

SEQ ID NO: 463 - protein, 6 aa, Artificial Sequence
  Description of Artificial Sequence: Synthetic peptide
SSSAIS

SEQ ID NO: 464 - protein, 16 aa, Artificial Sequence
  Description of Artificial Sequence: Synthetic peptide
IIRSGGTTDYASWAKG

SEQ ID NO: 465 - protein, 12 aa, Artificial Sequence
  Description of Artificial Sequence: Synthetic peptide
DPPYITSTYFDL

SEQ ID NO: 466 - protein, 13 aa, Artificial Sequence
  Description of Artificial Sequence: Synthetic peptide
KRARDSVESYDVH

SEQ ID NO: 467 - protein, 7 aa, Artificial Sequence
  Description of Artificial Sequence: Synthetic peptide
KDDQRPS

SEQ ID NO: 468 - protein, 9 aa, Artificial Sequence
  Description of Artificial Sequence: Synthetic peptide
QSFDGDAVV

SEQ ID NO: 469 - protein, 6 aa, Artificial Sequence
  Description of Artificial Sequence: Synthetic peptide
SNYAMS

SEQ ID NO: 470 - protein, 16 aa, Artificial Sequence
  Description of Artificial Sequence: Synthetic peptide
IVSSGGTTYYASWAKG

SEQ ID NO: 471 - protein, 14 aa, Artificial Sequence
  Description of Artificial Sequence: Synthetic peptide
DLYYGPTTYSAFNL

SEQ ID NO: 472 - protein, 11 aa, Artificial Sequence
  Description of Artificial Sequence: Synthetic peptide
TADTLSRSYAS

SEQ ID NO: 473 - protein, 7 aa, Artificial Sequence
  Description of Artificial Sequence: Synthetic peptide
RDTSRPS

SEQ ID NO: 474 - protein, 12 aa, Artificial Sequence
  Description of Artificial Sequence: Synthetic peptide
ATSDGSGSNFQL

SEQ ID NO: 475 - protein, 6 aa, Artificial Sequence
  Description of Artificial Sequence: Synthetic peptide
SNYAMG

SEQ ID NO: 476 - protein, 16 aa, Artificial Sequence
  Description of Artificial Sequence: Synthetic peptide
TINDGGTAFYANWLKG

SEQ ID NO: 477 - protein, 15 aa, Artificial Sequence
  Description of Artificial Sequence: Synthetic peptide
AYGSNGDVYWGYFNL

SEQ ID NO: 478 - protein, 12 aa, Artificial Sequence
  Description of Artificial Sequence: Synthetic peptide
QASQSISSRSLS

SEQ ID NO: 479 - protein, 7 aa, Artificial Sequence
  Description of Artificial Sequence: Synthetic peptide
EASKLAS

SEQ ID NO: 480 - protein, 11 aa, Artificial Sequence
  Description of Artificial Sequence: Synthetic peptide
QQGYSSSNVDN

SEQ ID NO: 481 - protein, 6 aa, Artificial Sequence
  Description of Artificial Sequence: Synthetic peptide
NNYAMG

SEQ ID NO: 482 - protein, 14 aa, Artificial Sequence
  Description of Artificial Sequence: Synthetic peptide
TINNDGATYYPSWA

SEQ ID NO: 483 - protein, 15 aa, Artificial Sequence
  Description of Artificial Sequence: Synthetic peptide
TYGSNGDVYWGYFNL

SEQ ID NO: 484 - protein, 11 aa, Artificial Sequence
  Description of Artificial Sequence: Synthetic peptide
QASQSIGGALN

SEQ ID NO: 485 - protein, 7 aa, Artificial Sequence
  Description of Artificial Sequence: Synthetic peptide
LASTLAS

SEQ ID NO: 486 - protein, 12 aa, Artificial Sequence
  Description of Artificial Sequence: Synthetic peptide
QQGYSASNIDNA

SEQ ID NO: 487 - protein, 6 aa, Artificial Sequence
  Description of Artificial Sequence: Synthetic peptide
SSYGVN

SEQ ID NO: 488 - protein, 16 aa, Artificial Sequence
  Description of Artificial Sequence: Synthetic peptide
FIFGDGTTYYANWAKG

SEQ ID NO: 489 - protein, 12 aa, Artificial Sequence
  Description of Artificial Sequence: Synthetic peptide
DGYGGYDYIINL

SEQ ID NO: 490 - protein, 10 aa, Artificial Sequence
  Description of Artificial Sequence: Synthetic peptide
QSSQSVVNNN

SEQ ID NO: 491 - protein, 7 aa, Artificial Sequence
  Description of Artificial Sequence: Synthetic peptide
KASTLES

SEQ ID NO: 492 - protein, 13 aa, Artificial Sequence
  Description of Artificial Sequence: Synthetic peptide
LGEFSCSSADCHA

SEQ ID NO: 493 - protein, 6 aa, Artificial Sequence
  Description of Artificial Sequence: Synthetic peptide
SSYGVN

SEQ ID NO: 494 - protein, 16 aa, Artificial Sequence
  Description of Artificial Sequence: Synthetic peptide
FIFGDGTTYYANWAKG

SEQ ID NO: 495 - protein, 12 aa, Artificial Sequence
  Description of Artificial Sequence: Synthetic peptide
DGYGGYDYIINL

SEQ ID NO: 496 - protein, 10 aa, Artificial Sequence
  Description of Artificial Sequence: Synthetic peptide
QSSQSVVNNN

SEQ ID NO: 497 - protein, 7 aa, Artificial Sequence
  Description of Artificial Sequence: Synthetic peptide
KASTLES

SEQ ID NO: 498 - protein, 12 aa, Artificial Sequence
  Description of Artificial Sequence: Synthetic peptide
QGAYSGNIYYNA

SEQ ID NO: 499 - protein, 6 aa, Artificial Sequence
  Description of Artificial Sequence: Synthetic peptide
STYAIS

SEQ ID NO: 500 - protein, 16 aa, Artificial Sequence
  Description of Artificial Sequence: Synthetic peptide
FIDTVDSAYYASWAKG

SEQ ID NO: 501 - protein, 11 aa, Artificial Sequence
  Description of Artificial Sequence: Synthetic peptide
LRYGDYGDYTL

SEQ ID NO: 502 - protein, 11 aa, Artificial Sequence
  Description of Artificial Sequence: Synthetic peptide
QASQNIYSYLA

SEQ ID NO: 503 - protein, 7 aa, Artificial Sequence
  Description of Artificial Sequence: Synthetic peptide
KASTLAS

SEQ ID NO: 504 - protein, 9 aa, Artificial Sequence
  Description of Artificial Sequence: Synthetic peptide
QCTYYDSNT

SEQ ID NO: 505 - protein, 6 aa, Artificial Sequence
  Description of Artificial Sequence: Synthetic peptide
STFAMT

SEQ ID NO: 506 - protein, 16 aa, Artificial Sequence
  Description of Artificial Sequence: Synthetic peptide
IINTGGSAYYTSWAKG

SEQ ID NO: 507 - protein, 9 aa, Artificial Sequence
  Description of Artificial Sequence: Synthetic peptide
GDWSSATDL

SEQ ID NO: 508 - protein, 13 aa, Artificial Sequence
  Description of Artificial Sequence: Synthetic peptide
QASQSVYDNKVLA

SEQ ID NO: 509 - protein, 7 aa, Artificial Sequence
  Description of Artificial Sequence: Synthetic peptide
KASTLAS

SEQ ID NO: 510 - protein, 13 aa, Artificial Sequence
  Description of Artificial Sequence: Synthetic peptide
LGEFSCSSADCHA

SEQ ID NO: 511 - protein, 122 aa, Artificial Sequence
  Description of Artificial Sequence: Synthetic polypeptide
ESQVLESGGGSVQPGGSLRLSCTVSGFSLSNYAMSWVRQAPGKGLEYIGIVSSGGTTYYASWAKGRFTISKDTSKNTVYLQMNSLRAEDTASYYCAKDLYYGPTTQSAFNLWGQGTSVTVSS

SEQ ID NO: 512 - protein, 122 aa, Artificial Sequence
  Description of Artificial Sequence: Synthetic polypeptide
ESQVLESGGGSVQPGGSLRLSCTVSGFSLSNYAMSWVRQAPGKGLEYIGIVSSGGTTYYASWAKGRFTISKDTSKNTVYLQMNSLRAEDTASYYCAKDLYYGPTTYHDLNLWGQGTSVTVSS

SEQ ID NO: 513 - protein, 122 aa, Artificial Sequence
  Description of Artificial Sequence: Synthetic polypeptide
ESQVLESGGGSVQPGGSLRLSCTVSGFSLSNYAMSWVRQAPGKGLEYIGIVSSGGTTYYASWAKGRFTISKDTSKNTVYLQMNSLRAEDTASYYCAKNVYYGPTTYSAFNLWGQGTSVTVSS

SEQ ID NO: 514 - protein, 122 aa, Artificial Sequence
  Description of Artificial Sequence: Synthetic polypeptide
ESQVLESGGGSVQPGGSLRLSCTVSGFSLSNYAMSWVRQAPGKGLEYIGIVSSGGTTYYASWAKGRFTISKDTSKNTVYLQMNSLRAEDTASYYCAKDLYYGPTTYHQLNLWGQGTSVTVSS

SEQ ID NO: 515 - protein, 122 aa, Artificial Sequence
  Description of Artificial Sequence: Synthetic polypeptide
ESQVLESGGGSVQPGGSLRLSCTVSGFSLSNYAMSWVRQAPGKGLEYIGIVSSGGTTYYASWAKGRFTISKDTSKNTVYLQMNSLRAEDTASYYCAKDLYYGPTTYSAFNLWGQGTSVTVSS

SEQ ID NO: 516 - protein, 122 aa, Artificial Sequence
  Description of Artificial Sequence: Synthetic polypeptide
ESQVLESGGGSVQPGGSLRLSCTVSGFSLSNYAMSWVRQAPGKGLEYIGIVSSGGRKRYASWAKGRFTISKDTSKNTVYLQMNSLRAEDTASYYCAKDLYYGPTTYSAFNLWGQGTSVTVSS

SEQ ID NO: 517 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPTTYSAFNLWGQGTSVTVSS

SEQ ID NO: 518 - protein, 122 aa, Artificial Sequence; identical to SEQ ID NO: 517
  Description of Artificial Sequence: Synthetic polypeptide

SEQ ID NO: 519 - protein, 122 aa, Artificial Sequence; identical to SEQ ID NO: 517
  Description of Artificial Sequence: Synthetic polypeptide

SEQ ID NO: 520 - protein, 122 aa, Artificial Sequence; identical to SEQ ID NO: 517
  Description of Artificial Sequence: Synthetic polypeptide

SEQ ID NO: 521 - protein, 122 aa, Artificial Sequence; identical to SEQ ID NO: 517
  Description of Artificial Sequence: Synthetic polypeptide

SEQ ID NO: 522 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPTTQSAFNLWGQGTSVTVSS

SEQ ID NO: 523 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKNVYYGPTTYSAFNLWGQGTSVTVSS

SEQ ID NO: 524 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKNVYYGPTTQSAFNLWGQGTSVTVSS

SEQ ID NO: 525 - protein, 122 aa, Artificial Sequence; identical to SEQ ID NO: 524
  Description of Artificial Sequence: Synthetic polypeptide

SEQ ID NO: 526 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPTTYHDLNLWGQGTSVTVSS

SEQ ID NO: 527 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGRKRYASWAKGRFTISKDTSKNTVYLQMNSLRAEDTASYYCAKDLYYGPTTYSAFNLWGQGTSVTVSS

SEQ ID NO: 528 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKALYYGPTTYSAFNLWGQGTSVTVSS

SEQ ID NO: 529 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLAYGPTTYSAFNLWGQGTSVTVSS

SEQ ID NO: 530 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYAGPTTYSAFNLWGQGTSVTVSS

SEQ ID NO: 531 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYAPTTYSAFNLWGQGTSVTVSS

SEQ ID NO: 532 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGATTYSAFNLWGQGTSVTVSS

SEQ ID NO: 533 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPATYSAFNLWGQGTSVTVSS

SEQ ID NO: 534 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPTAYSAFNLWGQGTSVTVSS

SEQ ID NO: 535 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPTTASAFNLWGQGTSVTVSS

SEQ ID NO: 536 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPTTYAAFNLWGQGTSVTVSS

SEQ ID NO: 537 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPTTYSSFNLWGQGTSVTVSS

SEQ ID NO: 538 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPTTYSAANLWGQGTSVTVSS

SEQ ID NO: 539 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPTTYSAFALWGQGTSVTVSS

SEQ ID NO: 540 - protein, 122 aa, Artificial Sequence; identical to SEQ ID NO: 517
  Description of Artificial Sequence: Synthetic polypeptide

SEQ ID NO: 541 - protein, 122 aa, Artificial Sequence; identical to SEQ ID NO: 517
  Description of Artificial Sequence: Synthetic polypeptide

SEQ ID NO: 542 - protein, 122 aa, Artificial Sequence; identical to SEQ ID NO: 517
  Description of Artificial Sequence: Synthetic polypeptide

SEQ ID NO: 543 - protein, 122 aa, Artificial Sequence; identical to SEQ ID NO: 517
  Description of Artificial Sequence: Synthetic polypeptide

SEQ ID NO: 544 - protein, 122 aa, Artificial Sequence; identical to SEQ ID NO: 517
  Description of Artificial Sequence: Synthetic polypeptide

SEQ ID NO: 545 - protein, 122 aa, Artificial Sequence; identical to SEQ ID NO: 517
  Description of Artificial Sequence: Synthetic polypeptide

SEQ ID NO: 546 - protein, 122 aa, Artificial Sequence; identical to SEQ ID NO: 517
  Description of Artificial Sequence: Synthetic polypeptide

SEQ ID NO: 547 - protein, 122 aa, Artificial Sequence; identical to SEQ ID NO: 517
  Description of Artificial Sequence: Synthetic polypeptide

SEQ ID NO: 548 - protein, 122 aa, Artificial Sequence; identical to SEQ ID NO: 517
  Description of Artificial Sequence: Synthetic polypeptide

SEQ ID NO: 549 - protein, 122 aa, Artificial Sequence; identical to SEQ ID NO: 517
  Description of Artificial Sequence: Synthetic polypeptide

SEQ ID NO: 550 - protein, 122 aa, Artificial Sequence; identical to SEQ ID NO: 517
  Description of Artificial Sequence: Synthetic polypeptide

SEQ ID NO: 551 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGAVSSGGTTYYASWAKGRFTISKDTSKNTVYLQMNSLRAEDTASYYCAKDLYYGPTTYSAFNLWGQGTSVTVSS

SEQ ID NO: 552 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIASSGGTTYYASWAKGRFTISKDTSKNTVYLQMNSLRAEDTASYYCAKDLYYGPTTYSAFNLWGQGTSVTVSS

SEQ ID NO: 553 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVASGGTTYYASWAKGRFTISKDTSKNTVYLQMNSLRAEDTASYYCAKDLYYGPTTYSAFNLWGQGTSVTVSS

SEQ ID NO: 554 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSAGGTTYYASWAKGRFTISKDTSKNTVYLQMNSLRAEDTASYYCAKDLYYGPTTYSAFNLWGQGTSVTVSS

SEQ ID NO: 555 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSAGTTYYASWAKGRFTISKDTSKNTVYLQMNSLRAEDTASYYCAKDLYYGPTTYSAFNLWGQGTSVTVSS

SEQ ID NO: 556 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGATTYYASWAKGRFTISKDTSKNTVYLQMNSLRAEDTASYYCAKDLYYGPTTYSAFNLWGQGTSVTVSS

SEQ ID NO: 557 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGATYYASWAKGRFTISKDTSKNTVYLQMNSLRAEDTASYYCAKDLYYGPTTYSAFNLWGQGTSVTVSS

SEQ ID NO: 558 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTAYYASWAKGRFTISKDTSKNTVYLQMNSLRAEDTASYYCAKDLYYGPTTYSAFNLWGQGTSVTVSS

SEQ ID NO: 559 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTAYASWAKGRFTISKDTSKNTVYLQMNSLRAEDTASYYCAKDLYYGPTTYSAFNLWGQGTSVTVSS

SEQ ID NO: 560 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYAASWAKGRFTISKDTSKNTVYLQMNSLRAEDTASYYCAKDLYYGPTTYSAFNLWGQGTSVTVSS

SEQ ID NO: 561 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYSSWAKGRFTISKDTSKNTVYLQMNSLRAEDTASYYCAKDLYYGPTTYSAFNLWGQGTSVTVSS

SEQ ID NO: 562 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYAAWAKGRFTISKDTSKNTVYLQMNSLRAEDTASYYCAKDLYYGPTTYSAFNLWGQGTSVTVSS

SEQ ID NO: 563 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASAAKGRFTISKDTSKNTVYLQMNSLRAEDTASYYCAKDLYYGPTTYSAFNLWGQGTSVTVSS

SEQ ID NO: 564 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWSKGRFTISKDTSKNTVYLQMNSLRAEDTASYYCAKDLYYGPTTYSAFNLWGQGTSVTVSS

SEQ ID NO: 565 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAAGRFTISKDTSKNTVYLQMNSLRAEDTASYYCAKDLYYGPTTYSAFNLWGQGTSVTVSS

SEQ ID NO: 566 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKARFTISKDTSKNTVYLQMNSLRAEDTASYYCAKDLYYGPTTYSAFNLWGQGTSVTVSS

SEQ ID NO: 567 - protein, 122 aa, Artificial Sequence; identical to SEQ ID NO: 538
  Description of Artificial Sequence: Synthetic polypeptide

SEQ ID NO: 568 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPTTYSALNLWGQGTSVTVSS

SEQ ID NO: 569 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPTTYSAPNLWGQGTSVTVSS

SEQ ID NO: 570 - protein, 122 aa, Artificial Sequence; identical to SEQ ID NO: 538
  Description of Artificial Sequence: Synthetic polypeptide

SEQ ID NO: 571 - protein, 122 aa, Artificial Sequence; identical to SEQ ID NO: 538
  Description of Artificial Sequence: Synthetic polypeptide

SEQ ID NO: 572 - protein, 122 aa, Artificial Sequence; identical to SEQ ID NO: 538
  Description of Artificial Sequence: Synthetic polypeptide

SEQ ID NO: 573 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPTTYSSANLWGQGTSVTVSS

SEQ ID NO: 574 - protein, 122 aa, Artificial Sequence; identical to SEQ ID NO: 538
  Description of Artificial Sequence: Synthetic polypeptide

SEQ ID NO: 575 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPSTYFVANLWGQGTSVTVSS

SEQ ID NO: 576 - protein, 122 aa, Artificial Sequence; identical to SEQ ID NO: 538
  Description of Artificial Sequence: Synthetic polypeptide

SEQ ID NO: 577 - protein, 122 aa, Artificial Sequence; identical to SEQ ID NO: 538
  Description of Artificial Sequence: Synthetic polypeptide

SEQ ID NO: 578 - protein, 122 aa, Artificial Sequence; identical to SEQ ID NO: 538
  Description of Artificial Sequence: Synthetic polypeptide

SEQ ID NO: 579 - protein, 122 aa, Artificial Sequence; identical to SEQ ID NO: 538
  Description of Artificial Sequence: Synthetic polypeptide

SEQ ID NO: 580 - protein, 123 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYASWAKGRFTISKDTSKNTVYLQMNSLRAEDTASYYCAKDLYYGPNTDYSAANLWGQGTSVTVSS

SEQ ID NO: 581 - protein, 122 aa, Artificial Sequence; identical to SEQ ID NO: 575
  Description of Artificial Sequence: Synthetic polypeptide

SEQ ID NO: 582 - protein, 123 aa, Artificial Sequence; identical to SEQ ID NO: 580
  Description of Artificial Sequence: Synthetic polypeptide

SEQ ID NO: 583 - protein, 122 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYADSVKGRFTISKDTSKNTVYLQMNSLRAEDTASYYCAKDLYYGPSTYFVANLWGQGTSVTVSS

SEQ ID NO: 584 - protein, 123 aa, Artificial Sequence
  Description of Artificial Sequence: Synthetic polypeptide
EVQLLESGGGSVQPGGSLRLSCTVSGFSLSNYAMSWVRQAPGKGLEWIGIVSSGGTTYYADSVKGRFTISKDTSKNTVYLQMNSLRAEDTASYYCAKDLYYGPNTDYSAANLWGQGTSVTVSS

SEQ ID NO: 585 - protein, 16 aa, Artificial Sequence
  Description of Artificial Sequence: Synthetic peptide
IVSSGGTTYYASWAKG

SEQ ID NO: 586 - protein, 16 aa, Artificial Sequence
  Description of Artificial Sequence: Synthetic peptide
IVSSGGTTYYASWAKG

SEQ ID NO: 587 - protein, 16 aa, Artificial Sequence
  Description of Artificial Sequence: Synthetic peptide
IVSSGGTTYYASWAKG

SEQ ID NO: 588 - protein, 16 aa, Artificial Sequence
  Description of Artificial Sequence: Synthetic peptide
IVSSGGTTYYASWAKG

SEQ ID NO: 589 - protein, 16 aa, Artificial Sequence
  Description of Artificial Sequence: Synthetic peptide
IVSSGGTTYYASWAKG

SEQ ID NO: 590 - protein, 16 aa, Artificial Sequence
  Description of Artificial Sequence: Synthetic peptide
IVSSGGRKRYASWAKG

SEQ ID NO: 591 - protein, 16 aa, Artificial Sequence
  Description of Artificial Sequence: Synthetic peptide
IVSSGGTTYYASWAKG

SEQ ID NO: 592 - protein, 16 aa, Artificial Sequence
  Description of Artificial Sequence: Synthetic peptide
IVSSGGTTYYASWAKG

SEQ ID NO: 593 - protein, 16 aa, Artificial Sequence
  Description of Artificial Sequence: Synthetic peptide
IVSSGGTTYYASWAKG

SEQ ID NO: 594 - protein, 16 aa, Artificial Sequence
  Description of Artificial Sequence: Synthetic peptide
IVSSGGTTYYASWAKG

SEQ ID NO: 595 - protein, 16 aa, Artificial Sequence
  Description of Artificial Sequence: Synthetic peptide
IVSSGGTTYYASWAKG

SEQ ID NO: 596 - protein, 16 aa, Artificial Sequence
  Description of Artificial Sequence: Synthetic peptide
IVSSGGTTYYASWAKG

SEQ ID NO: 597 - protein, 16 aa, Artificial Sequence
  Description of Artificial Sequence: Synthetic peptide
IVSSGGTTYYASWAKG

SEQ ID NO: 598 - protein, 16 aa, Artificial Sequence
  Description of Artificial Sequence: Synthetic peptide
IVSSGGTTYYASWAKG

SEQ ID NO: 599 - protein, 16 aa, Artificial Sequence
  Description of Artificial Sequence: Synthetic peptide
IVSSGGTTYYASWAKG

SEQ ID NO: 600 - protein, 16 aa, Artificial Sequence
  Description of Artificial Sequence: Synthetic peptide
IVSSGGTTYYASWAKG

SEQ ID NO: 601 - protein, 16 aa, Artificial Sequence
  Description of Artificial Sequence: Synthetic peptide
IVSSGGRKRYASWAKG

SEQ ID NO: 602 - protein, 16 aa, Artificial Sequence
  Description of Artificial Sequence: Synthetic peptide
IVSSGGTTYYASWAKG

SEQ ID NO: 603 - protein, 16 aa, Artificial Sequence
  Description of Artificial Sequence: Synthetic peptide
IVSSGGTTYYASWAKG

SEQ ID NO: 604 - protein, 16 aa, Artificial Sequence
  Description of Artificial Sequence: Synthetic peptide
IVSSGGTTYYASWAKG

SEQ ID NO: 605 - protein, 16 aa, Artificial Sequence
  Description of Artificial Sequence: Synthetic peptide
IVSSGGTTYYASWAKG

SEQ ID NO: 606 - protein, 16 aa, Artificial Sequence
  Description of Artificial Sequence: Synthetic peptide
IVSSGGTTYYASWAKG

SEQ ID NO: 607 - protein, 16 aa, Artificial Sequence
  Description of Artificial Sequence: Synthetic peptide
IVSSGGTTYYASWAKG

SEQ ID NO: 608 - protein, 16 aa, Artificial Sequence
  Description of Artificial Sequence: Synthetic peptide
IVSSGGTTYYASWAKG

SEQ ID NO: 609 - protein, 16 aa, Artificial Sequence
  Description of Artificial Sequence: Synthetic peptide
IVSSGGTTYYASWAKG

SEQ ID NO: 610 - protein, 16 aa, Artificial Sequence
  Description of Artificial Sequence: Synthetic peptide
IVSSGGTTYYASWAKG

SEQ ID NO: 611 - protein, 16 aa, Artificial Sequence
  Description of Artificial Sequence: Synthetic peptide
IVSSGGTTYYASWAKG

SEQ ID NO: 612 - protein, 16 aa, Artificial Sequence
  Description of Artificial Sequence: Synthetic peptide
IVSSGGTTYYASWAKG

SEQ ID NO: 613 - protein, 16 aa, Artificial Sequence
  Description of Artificial Sequence: Synthetic peptide
IVSSGGTTYYASWAKG

SEQ ID NO: 614 - protein, 16 aa, Artificial Sequence
  Description of Artificial Sequence: Synthetic peptide
IVSSGGTTYYASWAKG

SEQ ID NO: 615 - protein, 16 aa, Artificial Sequence
  Description of Artificial Sequence: Synthetic peptide
IVSSGGTTYYASWAKG

SEQ ID NO: 616 - protein, 16 aa, Artificial Sequence
  Description of Artificial Sequence: Synthetic peptide
IVSSGGTTYYASWAKG

SEQ ID NO: 617 - protein, 16 aa, Artificial Sequence
  Description of Artificial Sequence: Synthetic peptide
IVSSGGTTYYASWAKG

SEQ ID NO: 618 - protein, 16 aa, Artificial Sequence
  Description of Artificial Sequence: Synthetic peptide
IVSSGGTTYYASWAKG

SEQ ID NO: 619 - protein, 16 aa, Artificial Sequence
  Description of Artificial Sequence: Synthetic peptide
IVSSGGTTYYASWAKG

SEQ ID NO: 620 - protein, 16 aa, Artificial Sequence
  Description of Artificial Sequence: Synthetic peptide
IVSSGGTTYYASWAKG

SEQ ID NO: 621 - protein, 16 aa, Artificial Sequence
  Description of Artificial Sequence: Synthetic peptide
IVSSGGTTYYASWAKG

SEQ ID NO: 622 - protein, 16 aa, Artificial Sequence
  Description of Artificial Sequence: Synthetic peptide
IVSSGGTTYYASWAKG

SEQ ID NO: 623 - protein, 16 aa, Artificial Sequence
  Description of Artificial Sequence: Synthetic peptide
IVSSGGTTYYASWAKG

SEQ ID NO: 624 - protein, 16 aa, Artificial Sequence
  Description of Artificial Sequence: Synthetic peptide
IVSSGGTTYYASWAKG

SEQ ID NO: 625 - protein, 16 aa, Artificial Sequence
  Description of Artificial Sequence: Synthetic peptide
AVSSGGTTYYASWAKG

SEQ ID NO: 626 - protein, 16 aa, Artificial Sequence
  Description of Artificial Sequence: Synthetic peptide
IASSGGTTYYASWAKG

SEQ ID NO: 627 - protein, 16 aa, Artificial Sequence
  Description of Artificial Sequence: Synthetic peptide
IVASGGTTYYASWAKG

SEQ ID NO: 628 - protein, 16 aa, Artificial Sequence
  Description of Artificial Sequence: Synthetic peptide
IVSAGGTTYYASWAKG

SEQ ID NO: 629 - protein, 16 aa, Artificial Sequence
  Description of Artificial Sequence: Synthetic peptide
IVSSAGTTYYASWAKG

SEQ ID NO: 630 - protein, 16 aa, Artificial Sequence
  Description of Artificial Sequence: Synthetic peptide
IVSSGATTYYASWAKG

SEQ ID NO: 631 - protein, 16 aa, Artificial Sequence
  Description of Artificial Sequence: Synthetic peptide
IVSSGGATYYASWAKG

SEQ ID NO: 632 - protein, 16 aa, Artificial Sequence
  Description of Artificial Sequence: Synthetic peptide
IVSSGGTAYYASWAKG

SEQ ID NO: 633 - protein, 16 aa, Artificial Sequence
  Description of Artificial Sequence: Synthetic peptide
IVSSGGTTAYASWAKG

SEQ ID NO: 634 - protein, 16 aa, Artificial Sequence
  Description of Artificial Sequence: Synthetic peptide
IVSSGGTTYAASWAKG

SEQ ID NO: 635 - protein, 16 aa, Artificial Sequence
  Description of Artificial Sequence: Synthetic peptide
IVSSGGTTYYSSWAKG

SEQ ID NO: 636 - protein, 16 aa, Artificial Sequence
  Description of Artificial Sequence: Synthetic peptide
IVSSGGTTYYAAWAKG

SEQ ID NO: 637 - protein, 16 aa, Artificial Sequence
  Description of Artificial Sequence: Synthetic peptide
IVSSGGTTYYASAAKG

SEQ ID NO: 638 - protein, 16 aa, Artificial Sequence
  Description of Artificial Sequence: Synthetic peptide
IVSSGGTTYYASWSKG

SEQ ID NO: 639 - protein, 16 aa, Artificial Sequence
  Description of Artificial Sequence: Synthetic peptide
IVSSGGTTYYASWAAG

SEQ ID NO: 640 - protein, 16 aa, Artificial Sequence
  Description of Artificial Sequence: Synthetic peptide
IVSSGGTTYYASWAKA

SEQ ID NO: 641 - protein, 16 aa, Artificial Sequence
  Description of Artificial Sequence: Synthetic peptide
IVSSGGTTYYASWAKG

SEQ ID NO: 642 - protein, 16 aa, Artificial Sequence
  Description of Artificial Sequence: Synthetic peptide
IVSSGGTTYYASWAKG

SEQ ID NO: 643 - protein, 16 aa, Artificial Sequence
  Description of Artificial Sequence: Synthetic peptide
IVSSGGTTYYASWAKG

SEQ ID NO: 644 - protein, 16 aa, Artificial Sequence
  Description of Artificial Sequence: Synthetic peptide
IVSSGGTTYYASWAKG

SEQ ID NO: 645 - protein, 16 aa, Artificial Sequence
  Description of Artificial Sequence: Synthetic peptide
IVSSGGTTYYASWAKG

SEQ ID NO: 646 - protein, 16 aa, Artificial Sequence
  Description of Artificial Sequence: Synthetic peptide
IVSSGGTTYYASWAKG

SEQ ID NO: 647 - protein, 16 aa, Artificial Sequence
  Description of Artificial Sequence: Synthetic peptide
IVSSGGTTYYASWAKG

SEQ ID NO: 648 - protein, 16 aa, Artificial Sequence
  Description of Artificial Sequence: Synthetic peptide
IVSSGGTTYYASWAKG

SEQ ID NO: 649 - protein, 16 aa, Artificial Sequence
  Description of Artificial Sequence: Synthetic peptide
IVSSGGTTYYASWAKG

SEQ ID NO: 650 - protein, 16 aa, Artificial Sequence
  Description of Artificial Sequence: Synthetic peptide
IVSSGGTTYYASWAKG

SEQ ID NO: 651 - protein, 16 aa, Artificial Sequence
  Description of Artificial Sequence: Synthetic peptide
IVSSGGTTYYASWAKG

SEQ ID NO: 652 - protein, 16 aa, Artificial Sequence
  Description of Artificial Sequence: Synthetic peptide
IVSSGGTTYYASWAKG

SEQ ID NO: 653 - protein, 16 aa, Artificial Sequence
  Description of Artificial Sequence: Synthetic peptide
IVSSGGTTYYADSVKG

SEQ ID NO: 654 - protein, 16 aa, Artificial Sequence
  Description of Artificial Sequence: Synthetic peptide
IVSSGGTTYYASWAKG

SEQ ID NO: 655 - protein, 16 aa, Artificial Sequence
  Description of Artificial Sequence: Synthetic peptide
IVSSGGTTYYASWAKG

SEQ ID NO: 656 - protein, 16 aa, Artificial Sequence
  Description of Artificial Sequence: Synthetic peptide
IVSSGGTTYYASWAKG

SEQ ID NO: 657 - protein, 16 aa, Artificial Sequence
  Description of Artificial Sequence: Synthetic peptide
IVSSGGTTYYADSVKG

SEQ ID NO: 658 - protein, 16 aa, Artificial Sequence
  Description of Artificial Sequence: Synthetic peptide
IVSSGGTTYYADSVKG

SEQ ID NO: 659 - protein, 14 aa, Artificial Sequence
  Description of Artificial Sequence: Synthetic peptide
DLYYGPTTQSAFNL

SEQ ID NO: 660 - protein, 14 aa, Artificial Sequence
  Description of Artificial Sequence: Synthetic peptide
DLYYGPTTYHDLNL

SEQ ID NO: 661 - protein, 14 aa, Artificial Sequence
  Description of Artificial Sequence: Synthetic peptide
NVYYGPTTYSAFNL

SEQ ID NO: 662 - protein, 14 aa, Artificial Sequence
  Description of Artificial Sequence: Synthetic peptide
DLYYGPTTYHQLNL

SEQ ID NO: 663 - protein, 14 aa, Artificial Sequence
  Description of Artificial Sequence: Synthetic peptide
DLYYGPTTYSAFNL

SEQ ID NO: 664 - protein, 14 aa, Artificial Sequence
  Description of Artificial Sequence: Synthetic peptide
DLYYGPTTYSAFNL

SEQ ID NO: 665 - protein, 14 aa, Artificial Sequence
  Description of Artificial Sequence: Synthetic peptide
DLYYGPTTYSAFNL

SEQ ID NO: 666 - protein, 14 aa, Artificial Sequence
  Description of Artificial Sequence: Synthetic peptide
DLYYGPTTYSAFNL

SEQ ID NO: 667 - protein, 14 aa, Artificial Sequence
  Description of Artificial Sequence: Synthetic peptide
DLYYGPTTYSAFNL

SEQ ID NO: 668 - protein, 14 aa, Artificial Sequence
  Description of Artificial Sequence: Synthetic peptide
DLYYGPTTYSAFNL

SEQ ID NO: 669 - protein, 14 aa, Artificial Sequence
  Description of Artificial Sequence: Synthetic peptide
DLYYGPTTYSAFNL

SEQ ID NO: 670 - protein, 14 aa, Artificial Sequence
  Description of Artificial Sequence: Synthetic peptide
DLYYGPTTQSAFNL

SEQ ID NO: 671 - protein, 14 aa, Artificial Sequence
  Description of Artificial Sequence: Synthetic peptide
NVYYGPTTYSAFNL

SEQ ID NO: 672 - protein, 14 aa, Artificial Sequence
  Description of Artificial Sequence: Synthetic peptide
NVYYGPTTQSAFNL

SEQ ID NO: 673 - protein, 14 aa, Artificial Sequence
  Description of Artificial Sequence: Synthetic peptide
NVYYGPTTQSAFNL

SEQ ID NO: 674 - protein, 14 aa, Artificial Sequence
  Description of Artificial Sequence: Synthetic peptide
DLYYGPTTYHDLNL

SEQ ID NO: 675 - protein, 14 aa, Artificial Sequence
  Description of Artificial Sequence: Synthetic peptide
DLYYGPTTYSAFNL

SEQ ID NO: 676 - protein, 14 aa, Artificial Sequence
  Description of Artificial Sequence: Synthetic peptide
ALYYGPTTYSAFNL

SEQ ID NO: 677 - protein, 14 aa, Artificial Sequence
  Description of Artificial Sequence: Synthetic peptide
DLAYGPTTYSAFNL

SEQ ID NO: 678 - protein, 14 aa, Artificial Sequence
  Description of Artificial Sequence: Synthetic peptide
DLYAGPTTYSAFNL

SEQ ID NO: 679 - protein, 14 aa, Artificial Sequence
  Description of Artificial Sequence: Synthetic peptide
DLYYAPTTYSAFNL

SEQ ID NO: 680 - protein, 14 aa, Artificial Sequence
  Description of Artificial Sequence: Synthetic peptide
DLYYGATTYSAFNL

SEQ ID NO: 681 - protein, 14 aa, Artificial Sequence
  Description of Artificial Sequence: Synthetic peptide
DLYYGPATYSAFNL

SEQ ID NO: 682 - protein, 14 aa, Artificial Sequence
  Description of Artificial Sequence: Synthetic peptide
DLYYGPTAYSAFNL

SEQ ID NO: 683 - protein, 14 aa, Artificial Sequence
  Description of Artificial Sequence: Synthetic peptide
DLYYGPTTASAFNL

SEQ ID NO: 684 - protein, 14 aa, Artificial Sequence
  Description of Artificial Sequence: Synthetic peptide
DLYYGPTTYAAFNL

SEQ ID NO: 685 - protein, 14 aa, Artificial Sequence
  Description of Artificial Sequence: Synthetic peptide
DLYYGPTTYSSFNL

SEQ ID NO: 686 - protein, 14 aa, Artificial Sequence
  Description of Artificial Sequence: Synthetic peptide
DLYYGPTTYSAANL

SEQ ID NO: 687 - protein, 14 aa, Artificial Sequence
  Description of Artificial Sequence: Synthetic peptide
DLYYGPTTYSAFAL

SEQ ID NO: 688 - protein, 14 aa, Artificial Sequence
  Description of Artificial Sequence: Synthetic peptide
DLYYGPTTYSAFNL

SEQ ID NO: 689 - protein, 14 aa, Artificial Sequence
  Description of Artificial Sequence: Synthetic peptide
DLYYGPTTYSAFNL

SEQ ID NO: 690 - protein, 14 aa, Artificial Sequence
  Description of Artificial Sequence: Synthetic peptide
DLYYGPTTYSAFNL

SEQ ID NO: 691 - protein, 14 aa, Artificial Sequence
  Description of Artificial Sequence: Synthetic peptide
DLYYGPTTYSAFNL

SEQ ID NO: 692 - protein, 14 aa, Artificial Sequence
  Description of Artificial Sequence: Synthetic peptide
DLYYGPTTYSAFNL

SEQ ID NO: 693 - protein, 14 aa, Artificial Sequence
  Description of Artificial Sequence: Synthetic peptide
DLYYGPTTYSAFNL

SEQ ID NO: 694 - protein, 14 aa, Artificial Sequence
  Description of Artificial Sequence: Synthetic peptide
DLYYGPTTYSAFNL

SEQ ID NO: 695 - protein, 14 aa, Artificial Sequence
  Description of Artificial Sequence: Synthetic peptide
DLYYGPTTYSAFNL

SEQ ID NO: 696 - protein, 14 aa, Artificial Sequence
  Description of Artificial Sequence: Synthetic peptide
DLYYGPTTYSAFNL

SEQ ID NO: 697 - protein, 14 aa, Artificial Sequence
  Description of Artificial Sequence: Synthetic peptide
DLYYGPTTYSAFNL

SEQ ID NO: 698 - protein, 14 aa, Artificial Sequence
  Description of Artificial Sequence: Synthetic peptide
DLYYGPTTYSAFNL

SEQ ID NO: 699 - protein, 14 aa, Artificial Sequence
  Description of Artificial Sequence: Synthetic peptide
DLYYGPTTYSAFNL

SEQ ID NO: 700 - protein, 14 aa, Artificial Sequence
  Description of Artificial Sequence: Synthetic peptide
DLYYGPTTYSAFNL

SEQ ID NO: 701 - protein, 14 aa, Artificial Sequence
  Description of Artificial Sequence: Synthetic peptide
DLYYGPTTYSAFNL

SEQ ID NO: 702 - protein, 14 aa, Artificial Sequence
  Description of Artificial Sequence: Synthetic peptide
DLYYGPTTYSAFNL

SEQ ID NO: 703 - protein, 14 aa, Artificial Sequence
  Description of Artificial Sequence: Synthetic peptide
DLYYGPTTYSAFNL

SEQ ID NO: 704 - protein, 14 aa, Artificial Sequence
  Description of Artificial Sequence: Synthetic peptide
DLYYGPTTYSAFNL

SEQ ID NO: 705 - protein, 14 aa, Artificial Sequence
  Description of Artificial Sequence: Synthetic peptide
DLYYGPTTYSAFNL

SEQ ID NO: 706 - protein, 14 aa, Artificial Sequence
  Description of Artificial Sequence: Synthetic peptide
DLYYGPTTYSAFNL

SEQ ID NO: 707 - protein, 14 aa, Artificial Sequence
  Description of Artificial Sequence: Synthetic peptide
DLYYGPTTYSAFNL

SEQ ID NO: 708 - protein, 14 aa, Artificial Sequence
  Description of Artificial Sequence: Synthetic peptide
DLYYGPTTYSAFNL

SEQ ID NO: 709 - protein, 14 aa, Artificial Sequence
  Description of Artificial Sequence: Synthetic peptide
DLYYGPTTYSAFNL

SEQ ID NO: 710 - protein, 14 aa, Artificial Sequence
  Description of Artificial Sequence: Synthetic peptide
DLYYGPTTYSAFNL

SEQ ID NO: 711 - protein, 14 aa, Artificial Sequence
  Description of Artificial Sequence: Synthetic peptide
DLYYGPTTYSAFNL

SEQ ID NO: 712 - protein, 14 aa, Artificial Sequence
  Description of Artificial Sequence: Synthetic peptide
DLYYGPTTYSAFNL

SEQ ID NO: 713 - protein, 14 aa, Artificial Sequence
  Description of Artificial Sequence: Synthetic peptide
DLYYGPTTYSAFNL

SEQ ID NO: 714 - protein, 14 aa, Artificial Sequence
  Description of Artificial Sequence: Synthetic peptide
DLYYGPTTYSAFNL

SEQ ID NO: 715 - protein, 14 aa, Artificial Sequence
  Description of Artificial Sequence: Synthetic peptide
DLYYGPTTYSAANL

SEQ ID NO: 716 - protein, 14 aa, Artificial Sequence
  Description of Artificial Sequence: Synthetic peptide
DLYYGPTTYSALNL

SEQ ID NO: 717 - protein, 14 aa, Artificial Sequence
  Description of Artificial Sequence: Synthetic peptide
DLYYGPTTYSAPNL

SEQ ID NO: 718 - protein, 14 aa, Artificial Sequence
  Description of Artificial Sequence: Synthetic peptide
DLYYGPTTYSAANL

SEQ ID NO: 719 - protein, 14 aa, Artificial Sequence
  Description of Artificial Sequence: Synthetic peptide
DLYYGPTTYSAANL

SEQ ID NO: 720 - protein, 14 aa, Artificial Sequence
  Description of Artificial Sequence: Synthetic peptide
DLYYGPTTYSAANL

SEQ ID NO: 721 - protein, 14 aa, Artificial Sequence
  Description of Artificial Sequence: Synthetic peptide
DLYYGPTTYSSANL

SEQ ID NO: 722 - protein, 14 aa, Artificial Sequence
  Description of Artificial Sequence: Synthetic peptide
DLYYGPTTYSAANL

SEQ ID NO: 723 - protein, 14 aa, Artificial Sequence
  Description of Artificial Sequence: Synthetic peptide
DLYYGPSTYFVANL

SEQ ID NO: 724 - protein, 14 aa, Artificial Sequence
  Description of Artificial Sequence: Synthetic peptide
DLYYGPTTYSAANL

SEQ ID NO: 725 - protein, 14 aa, Artificial Sequence
  Description of Artificial Sequence: Synthetic peptide
DLYYGPTTYSAANL

SEQ ID NO: 726 - protein, 14 aa, Artificial Sequence
  Description of Artificial Sequence: Synthetic peptide
DLYYGPTTYSAANL

SEQ ID NO: 727 - protein, 14 aa, Artificial Sequence
  Description of Artificial Sequence: Synthetic peptide
DLYYGPTTYSAANL

SEQ ID NO: 728 - protein, 15 aa, Artificial Sequence
  Description of Artificial Sequence: Synthetic peptide
DLYYGPNTDYSAANL

SEQ ID NO: 729 - protein, 14 aa, Artificial Sequence
  Description of Artificial Sequence: Synthetic peptide
DLYYGPSTYFVANL

SEQ ID NO: 730 - protein, 15 aa, Artificial Sequence
  Description of Artificial Sequence: Synthetic peptide
DLYYGPNTDYSAANL

SEQ ID NO: 731 - protein, 14 aa, Artificial Sequence
  Description of Artificial Sequence: Synthetic peptide
DLYYGPSTYFVANL

SEQ ID NO: 732 - protein, 15 aa, Artificial Sequence
  Description of Artificial Sequence: Synthetic peptide
DLYYGPNTDYSAANL

SEQ ID NO: 733 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATSDGSGSNFQLFGGGTKLTVL

SEQ ID NO: 734 - protein, 109 aa, Artificial Sequence; identical to SEQ ID NO: 733
  Description of Artificial Sequence: Synthetic polypeptide

SEQ ID NO: 735 - protein, 109 aa, Artificial Sequence; identical to SEQ ID NO: 733
  Description of Artificial Sequence: Synthetic polypeptide

SEQ ID NO: 736 - protein, 109 aa, Artificial Sequence; identical to SEQ ID NO: 733
  Description of Artificial Sequence: Synthetic polypeptide

SEQ ID NO: 737 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPSSGSNFQLFGGGTKLTVL

SEQ ID NO: 738 - protein, 109 aa, Artificial Sequence; identical to SEQ ID NO: 733
  Description of Artificial Sequence: Synthetic polypeptide

SEQ ID NO: 739 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATSPSSGSNFQLFGGGTKLTVL

SEQ ID NO: 740 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRDSSGSNFQLFGGGTKLTVL

SEQ ID NO: 741 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPGSGSNFQLFGGGTKLTVL

SEQ ID NO: 742 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPASGSNFQLFGGGTKLTVL

SEQ ID NO: 743 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATKPSSGSNFQLFGGGTKLTVL

SEQ ID NO: 744 - protein, 109 aa, Artificial Sequence; identical to SEQ ID NO: 737
  Description of Artificial Sequence: Synthetic polypeptide

SEQ ID NO: 745 - protein, 109 aa, Artificial Sequence; identical to SEQ ID NO: 737
  Description of Artificial Sequence: Synthetic polypeptide

SEQ ID NO: 746 - protein, 109 aa, Artificial Sequence; identical to SEQ ID NO: 737
  Description of Artificial Sequence: Synthetic polypeptide

SEQ ID NO: 747 - protein, 109 aa, Artificial Sequence; identical to SEQ ID NO: 733
  Description of Artificial Sequence: Synthetic polypeptide

SEQ ID NO: 748 - protein, 109 aa, Artificial Sequence; identical to SEQ ID NO: 737
  Description of Artificial Sequence: Synthetic polypeptide

SEQ ID NO: 749 - protein, 109 aa, Artificial Sequence; identical to SEQ ID NO: 737
  Description of Artificial Sequence: Synthetic polypeptide

SEQ ID NO: 750 - protein, 109 aa, Artificial Sequence; identical to SEQ ID NO: 737
  Description of Artificial Sequence: Synthetic polypeptide

SEQ ID NO: 751 - protein, 109 aa, Artificial Sequence; identical to SEQ ID NO: 737
  Description of Artificial Sequence: Synthetic polypeptide

SEQ ID NO: 752 - protein, 109 aa, Artificial Sequence; identical to SEQ ID NO: 737
  Description of Artificial Sequence: Synthetic polypeptide

SEQ ID NO: 753 - protein, 109 aa, Artificial Sequence; identical to SEQ ID NO: 737
  Description of Artificial Sequence: Synthetic polypeptide

SEQ ID NO: 754 - protein, 109 aa, Artificial Sequence; identical to SEQ ID NO: 737
  Description of Artificial Sequence: Synthetic polypeptide

SEQ ID NO: 755 - protein, 109 aa, Artificial Sequence; identical to SEQ ID NO: 737
  Description of Artificial Sequence: Synthetic polypeptide

SEQ ID NO: 756 - protein, 109 aa, Artificial Sequence; identical to SEQ ID NO: 737
  Description of Artificial Sequence: Synthetic polypeptide

SEQ ID NO: 757 - protein, 109 aa, Artificial Sequence; identical to SEQ ID NO: 737
  Description of Artificial Sequence: Synthetic polypeptide

SEQ ID NO: 758 - protein, 109 aa, Artificial Sequence; identical to SEQ ID NO: 737
  Description of Artificial Sequence: Synthetic polypeptide

SEQ ID NO: 759 - protein, 109 aa, Artificial Sequence; identical to SEQ ID NO: 737
  Description of Artificial Sequence: Synthetic polypeptide

SEQ ID NO: 760 - protein, 109 aa, Artificial Sequence; identical to SEQ ID NO: 737
  Description of Artificial Sequence: Synthetic polypeptide

SEQ ID NO: 761 - protein, 109 aa, Artificial Sequence; identical to SEQ ID NO: 737
  Description of Artificial Sequence: Synthetic polypeptide

SEQ ID NO: 762 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCSTRPSSGSNFQLFGGGTKLTVL

SEQ ID NO: 763 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCAARPSSGSNFQLFGGGTKLTVL

SEQ ID NO: 764 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATAPSSGSNFQLFGGGTKLTVL

SEQ ID NO: 765 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRASSGSNFQLFGGGTKLTVL

SEQ ID NO: 766 - protein, 109 aa, Artificial Sequence; identical to SEQ ID NO: 742
  Description of Artificial Sequence: Synthetic polypeptide

SEQ ID NO: 767 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPSAGSNFQLFGGGTKLTVL

SEQ ID NO: 768 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPSSASNFQLFGGGTKLTVL

SEQ ID NO: 769 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPSSGANFQLFGGGTKLTVL

SEQ ID NO: 770 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPSSGSNAQLFGGGTKLTVL

SEQ ID NO: 771 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPSSGSNFALFGGGTKLTVL

SEQ ID NO: 772 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPSSGSNFQAFGGGTKLTVL

SEQ ID NO: 773 - protein, 109 aa, Artificial Sequence; identical to SEQ ID NO: 737
  Description of Artificial Sequence: Synthetic polypeptide

SEQ ID NO: 774 - protein, 109 aa, Artificial Sequence; identical to SEQ ID NO: 737
  Description of Artificial Sequence: Synthetic polypeptide

SEQ ID NO: 775 - protein, 109 aa, Artificial Sequence; identical to SEQ ID NO: 737
  Description of Artificial Sequence: Synthetic polypeptide

SEQ ID NO: 776 - protein, 109 aa, Artificial Sequence; identical to SEQ ID NO: 737
  Description of Artificial Sequence: Synthetic polypeptide

SEQ ID NO: 777 - protein, 109 aa, Artificial Sequence; identical to SEQ ID NO: 737
  Description of Artificial Sequence: Synthetic polypeptide

SEQ ID NO: 778 - protein, 109 aa, Artificial Sequence; identical to SEQ ID NO: 737
  Description of Artificial Sequence: Synthetic polypeptide

SEQ ID NO: 779 - protein, 109 aa, Artificial Sequence; identical to SEQ ID NO: 737
  Description of Artificial Sequence: Synthetic polypeptide

SEQ ID NO: 780 - protein, 109 aa, Artificial Sequence; identical to SEQ ID NO: 737
  Description of Artificial Sequence: Synthetic polypeptide

SEQ ID NO: 781 - protein, 109 aa, Artificial Sequence; identical to SEQ ID NO: 737
  Description of Artificial Sequence: Synthetic polypeptide

SEQ ID NO: 782 - protein, 109 aa, Artificial Sequence; identical to SEQ ID NO: 737
  Description of Artificial Sequence: Synthetic polypeptide

SEQ ID NO: 783 - protein, 109 aa, Artificial Sequence; identical to SEQ ID NO: 737
  Description of Artificial Sequence: Synthetic polypeptide

SEQ ID NO: 784 - protein, 109 aa, Artificial Sequence; identical to SEQ ID NO: 737
  Description of Artificial Sequence: Synthetic polypeptide

SEQ ID NO: 785 - protein, 109 aa, Artificial Sequence; identical to SEQ ID NO: 737
  Description of Artificial Sequence: Synthetic polypeptide

SEQ ID NO: 786 - protein, 109 aa, Artificial Sequence; identical to SEQ ID NO: 737
  Description of Artificial Sequence: Synthetic polypeptide

SEQ ID NO: 787 - protein, 109 aa, Artificial Sequence; identical to SEQ ID NO: 737
  Description of Artificial Sequence: Synthetic polypeptide

SEQ ID NO: 788 - protein, 109 aa, Artificial Sequence; identical to SEQ ID NO: 737
  Description of Artificial Sequence: Synthetic polypeptide

SEQ ID NO: 789 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPSSGSNFVLFGGGTKLTVL

SEQ ID NO: 790 - protein, 109 aa, Artificial Sequence; identical to SEQ ID NO: 737
  Description of Artificial Sequence: Synthetic polypeptide

SEQ ID NO: 791 - protein, 109 aa, Artificial Sequence; identical to SEQ ID NO: 737
  Description of Artificial Sequence: Synthetic polypeptide

SEQ ID NO: 792 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPSSGSVFQLFGGGTKLTVL

SEQ ID NO: 793 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPSSGSNTVVFGGGTKLTVL

SEQ ID NO: 794 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCQARPSSGSNFQLFGGGTKLTVL

SEQ ID NO: 795 - protein, 109 aa, Artificial Sequence; identical to SEQ ID NO: 737
  Description of Artificial Sequence: Synthetic polypeptide

SEQ ID NO: 796 - protein, 109 aa, Artificial Sequence; identical to SEQ ID NO: 772
  Description of Artificial Sequence: Synthetic polypeptide

SEQ ID NO: 797 - protein, 109 aa, Artificial Sequence; identical to SEQ ID NO: 737
  Description of Artificial Sequence: Synthetic polypeptide

SEQ ID NO: 798 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPWPGSNFQLFGGGTKLTVL

SEQ ID NO: 799 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRPFPGSNFQLFGGGTKLTVL

SEQ ID NO: 800 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRLFSGSNFQLFGGGTKLTVL

SEQ ID NO: 801 - protein, 109 aa, Artificial Sequence
  Description of Artificial Sequence: Synthetic polypeptide
SYELTQPPSVSVSPGQTASITCTADTLSRSYASWYQQKPGQSPVLVIYRDTSRPSGIPERFSGSNSGNTATLTISGTQAMDEADYYCATRDFSGSNFQLFGGGTKLTVL

SEQ ID NO: 802 - protein, 109 aa, Artificial Sequence; identical to SEQ ID NO: 737
  Description of Artificial Sequence: Synthetic polypeptide

SEQ ID NO: 803 - protein, 109 aa, Artificial Sequence; identical to SEQ ID NO: 772
  Description of Artificial Sequence: Synthetic polypeptide

SEQ ID NO: 804 - protein, 109 aa, Artificial Sequence; identical to SEQ ID NO: 772
  Description of Artificial Sequence: Synthetic polypeptide

SEQ ID NO: 805 - protein, 109 aa, Artificial Sequence; identical to SEQ ID NO: 737
  Description of Artificial Sequence: Synthetic polypeptide

SEQ ID NO: 806 - protein, 109 aa, Artificial Sequence; identical to SEQ ID NO: 772
  Description of Artificial Sequence: Synthetic polypeptide

SEQ ID NO: 807 - protein, 12 aa, Artificial Sequence
  Description of Artificial Sequence: Synthetic peptide
ATSDGSGSNFQL

SEQ ID NO: 808 - protein, 12 aa, Artificial Sequence
  Description of Artificial Sequence: Synthetic peptide
ATSDGSGSNFQL

SEQ ID NO: 809 - protein, 12 aa, Artificial Sequence
  Description of Artificial Sequence: Synthetic peptide
ATSDGSGSNFQL

SEQ ID NO: 810 - protein, 12 aa, Artificial Sequence
  Description of Artificial Sequence: Synthetic peptide
ATSDGSGSNFQL

SEQ ID NO: 811 - protein, 12 aa, Artificial Sequence
  Description of Artificial Sequence: Synthetic peptide
ATRPSSGSNFQL

SEQ ID NO: 812 - protein, 12 aa, Artificial Sequence
  Description of Artificial Sequence: Synthetic peptide
ATSDGSGSNFQL

SEQ ID NO: 813 - protein, 12 aa, Artificial Sequence
  Description of Artificial Sequence: Synthetic peptide
ATSPSSGSNFQL

SEQ ID NO: 814 - protein, 12 aa, Artificial Sequence
  Description of Artificial Sequence: Synthetic peptide
ATRDSSGSNFQL

SEQ ID NO: 815 - protein, 12 aa, Artificial Sequence
  Description of Artificial Sequence: Synthetic peptide
ATRPGSGSNFQL

SEQ ID NO: 816 - protein, 12 aa, Artificial Sequence
  Description of Artificial Sequence: Synthetic peptide
ATRPASGSNFQL

SEQ ID NO: 817 - protein, 12 aa, Artificial Sequence
  Description of Artificial Sequence: Synthetic peptide
ATKPSSGSNFQL

SEQ ID NO: 818 - protein, 12 aa, Artificial Sequence
  Description of Artificial Sequence: Synthetic peptide
ATRPSSGSNFQL

SEQ ID NO: 819 - protein, 12 aa, Artificial Sequence
  Description of Artificial Sequence: Synthetic peptide
ATRPSSGSNFQL

SEQ ID NO: 820 - protein, 12 aa, Artificial Sequence
  Description of Artificial Sequence: Synthetic peptide
ATRPSSGSNFQL

SEQ ID NO: 821 - protein, 12 aa, Artificial Sequence
  Description of Artificial Sequence: Synthetic peptide
ATSDGSGSNFQL

SEQ ID NO: 822 - protein, 12 aa, Artificial Sequence
  Description of Artificial Sequence: Synthetic peptide
ATRPSSGSNFQL

SEQ ID NO: 823 - protein, 12 aa, Artificial Sequence
  Description of Artificial Sequence: Synthetic peptide
ATRPSSGSNFQL

SEQ ID NO: 824 - protein, 12 aa, Artificial Sequence
  Description of Artificial Sequence: Synthetic peptide
ATRPSSGSNFQL

SEQ ID NO: 825 - protein, 12 aa, Artificial Sequence
  Description of Artificial Sequence: Synthetic peptide
ATRPSSGSNFQL

SEQ ID NO: 826 - protein, 12 aa, Artificial Sequence
  Description of Artificial Sequence: Synthetic peptide
ATRPSSGSNFQL

SEQ ID NO: 827 - protein, 12 aa, Artificial Sequence
  Description of Artificial Sequence: Synthetic peptide
ATRPSSGSNFQL

SEQ ID NO: 828 - protein, 12 aa, Artificial Sequence
  Description of Artificial Sequence: Synthetic peptide
ATRPSSGSNFQL

SEQ ID NO: 829 - protein, 12 aa, Artificial Sequence
  Description of Artificial Sequence: Synthetic peptide
ATRPSSGSNFQL

SEQ ID NO: 830 - protein, 12 aa, Artificial Sequence
  Description of Artificial Sequence: Synthetic peptide
ATRPSSGSNFQL

SEQ ID NO: 831 - protein, 12 aa, Artificial Sequence
  Description of Artificial Sequence: Synthetic peptide
ATRPSSGSNFQL

SEQ ID NO: 832 - protein, 12 aa, Artificial Sequence
  Description of Artificial Sequence: Synthetic peptide
ATRPSSGSNFQL

SEQ ID NO: 833 - protein, 12 aa, Artificial Sequence
  Description of Artificial Sequence: Synthetic peptide
ATRPSSGSNFQL

SEQ ID NO: 834 - protein, 12 aa, Artificial Sequence
  Description of Artificial Sequence: Synthetic peptide
ATRPSSGSNFQL

SEQ ID NO: 835 - protein, 12 aa, Artificial Sequence
  Description of Artificial Sequence: Synthetic peptide
ATRPSSGSNFQL

SEQ ID NO: 836 - protein, 12 aa, Artificial Sequence
  Description of Artificial Sequence: Synthetic peptide
STRPSSGSNFQL

SEQ ID NO: 837 - protein, 12 aa, Artificial Sequence
  Description of Artificial Sequence: Synthetic peptide
AARPSSGSNFQL

SEQ ID NO: 838 - protein, 12 aa, Artificial Sequence
  Description of Artificial Sequence: Synthetic peptide
ATAPSSGSNFQL

SEQ ID NO: 839 - protein, 12 aa, Artificial Sequence
  Description of Artificial Sequence: Synthetic peptide
ATRASSGSNFQL

SEQ ID NO: 840 - protein, 12 aa, Artificial Sequence
  Description of Artificial Sequence: Synthetic peptide
ATRPASGSNFQL

SEQ ID NO: 841 - protein, 12 aa, Artificial Sequence
  Description of Artificial Sequence: Synthetic peptide
ATRPSAGSNFQL

SEQ ID NO: 842 - protein, 12 aa, Artificial Sequence
  Description of Artificial Sequence: Synthetic peptide
ATRPSSASNFQL

SEQ ID NO: 843 - protein, 12 aa, Artificial Sequence
  Description of Artificial Sequence: Synthetic peptide
ATRPSSGANFQL

SEQ ID NO: 844 - protein, 12 aa, Artificial Sequence
  Description of Artificial Sequence: Synthetic peptide
ATRPSSGSNAQL

SEQ ID NO: 845 - protein, 12 aa, Artificial Sequence
  Description of Artificial Sequence: Synthetic peptide
ATRPSSGSNFAL

SEQ ID NO: 846 - protein, 12 aa, Artificial Sequence
  Description of Artificial Sequence: Synthetic peptide
ATRPSSGSNFQA

SEQ ID NO: 847 - protein, 12 aa, Artificial Sequence
  Description of Artificial Sequence: Synthetic peptide
ATRPSSGSNFQL

SEQ ID NO: 848 - protein, 12 aa, Artificial Sequence
  Description of Artificial Sequence: Synthetic peptide
ATRPSSGSNFQL

SEQ ID NO: 849 - protein, 12 aa, Artificial Sequence
  Description of Artificial Sequence: Synthetic peptide
ATRPSSGSNFQL

SEQ ID NO: 850 - protein, 12 aa, Artificial Sequence
  Description of Artificial Sequence: Synthetic peptide
ATRPSSGSNFQL

SEQ ID NO: 851 - protein, 12 aa, Artificial Sequence
  Description of Artificial Sequence: Synthetic peptide
ATRPSSGSNFQL

SEQ ID NO: 852 - protein, 12 aa, Artificial Sequence
  Description of Artificial Sequence: Synthetic peptide
ATRPSSGSNFQL

SEQ ID NO: 853 - protein, 12 aa, Artificial Sequence
  Description of Artificial Sequence: Synthetic peptide
ATRPSSGSNFQL

SEQ ID NO: 854 - protein, 12 aa, Artificial Sequence
  Description of Artificial Sequence: Synthetic peptide
ATRPSSGSNFQL

SEQ ID NO: 855 - protein, 12 aa, Artificial Sequence
  Description of Artificial Sequence: Synthetic peptide
ATRPSSGSNFQL

SEQ ID NO: 856 - protein, 12 aa, Artificial Sequence
  Description of Artificial Sequence: Synthetic peptide
ATRPSSGSNFQL

SEQ ID NO: 857 - protein, 12 aa, Artificial Sequence
  Description of Artificial Sequence: Synthetic peptide
ATRPSSGSNFQL

SEQ ID NO: 858 - protein, 12 aa, Artificial Sequence
  Description of Artificial Sequence: Synthetic peptide
ATRPSSGSNFQL

SEQ ID NO: 859 - protein, 12 aa, Artificial Sequence
  Description of Artificial Sequence: Synthetic peptide
ATRPSSGSNFQL

SEQ ID NO: 860 - protein, 12 aa, Artificial Sequence
  Description of Artificial Sequence: Synthetic peptide
ATRPSSGSNFQL

SEQ ID NO: 861 - protein, 12 aa, Artificial Sequence
  Description of Artificial Sequence: Synthetic peptide
ATRPSSGSNFQL

SEQ ID NO: 862 - protein, 12 aa, Artificial Sequence
  Description of Artificial Sequence: Synthetic peptide
ATRPSSGSNFQL

SEQ ID NO: 863 - protein, 12 aa, Artificial Sequence
  Description of Artificial Sequence: Synthetic peptide
ATRPSSGSNFVL

SEQ ID NO: 864 - protein, 12 aa, Artificial Sequence
  Description of Artificial Sequence: Synthetic peptide
ATRPSSGSNFQL

SEQ ID NO: 865 - protein, 12 aa, Artificial Sequence
  Description of Artificial Sequence: Synthetic peptide
ATRPSSGSNFQL

SEQ ID NO: 866 - protein, 12 aa, Artificial Sequence
  Description of Artificial Sequence: Synthetic peptide
ATRPSSGSVFQL

SEQ ID NO: 867 - protein, 12 aa, Artificial Sequence
  Description of Artificial Sequence: Synthetic peptide
ATRPSSGSNTVV

SEQ ID NO: 868 - protein, 12 aa, Artificial Sequence
  Description of Artificial Sequence: Synthetic peptide
QARPSSGSNFQL

SEQ ID NO: 869 - protein, 12 aa, Artificial Sequence
  Description of Artificial Sequence: Synthetic peptide
ATRPSSGSNFQL

SEQ ID NO: 870 - protein, 12 aa, Artificial Sequence
  Description of Artificial Sequence: Synthetic peptide
ATRPSSGSNFQA

SEQ ID NO: 871 - protein, 12 aa, Artificial Sequence
  Description of Artificial Sequence: Synthetic peptide
ATRPSSGSNFQL

SEQ ID NO: 872 - protein, 12 aa, Artificial Sequence
  Description of Artificial Sequence: Synthetic peptide
ATRPWPGSNFQL

SEQ ID NO: 873 - protein, 12 aa, Artificial Sequence
  Description of Artificial Sequence: Synthetic peptide
ATRPFPGSNFQL

SEQ ID NO: 874 - protein, 12 aa, Artificial Sequence
  Description of Artificial Sequence: Synthetic peptide
ATRLFSGSNFQL

SEQ ID NO: 875 - protein, 12 aa, Artificial Sequence
  Description of Artificial Sequence: Synthetic peptide
ATRDFSGSNFQL

SEQ ID NO: 876 - protein, 12 aa, Artificial Sequence
  Description of Artificial Sequence: Synthetic peptide
ATRPSSGSNFQL

SEQ ID NO: 877 - protein, 12 aa, Artificial Sequence
  Description of Artificial Sequence: Synthetic peptide
ATRPSSGSNFQA

SEQ ID NO: 878 - protein, 12 aa, Artificial Sequence
  Description of Artificial Sequence: Synthetic peptide
ATRPSSGSNFQA

SEQ ID NO: 879 - protein, 12 aa, Artificial Sequence
  Description of Artificial Sequence: Synthetic peptide
ATRPSSGSNFQL

SEQ ID NO: 880 - protein, 12 aa, Artificial Sequence
  Description of Artificial Sequence: Synthetic peptide
ATRPSSGSNFQA

SEQ ID NO: 881 - protein, 16 aa, Artificial Sequence
  Description of Artificial Sequence: Synthetic peptide
  MOD_RES (12)..(12): S or D
  MOD_RES (13)..(13): W or S
  MOD_RES (14)..(14): A or V
IVSSGGTTYYAXXXKG

SEQ ID NO: 882 - protein, 15 aa, Artificial Sequence
  Description of Artificial Sequence: Synthetic peptide
  MOD_RES (7)..(7): T, N, or S
  MOD_RES (9)..(9): D or absent
  MOD_RES (11)..(11): S or F
  MOD_RES (12)..(12): A or V
  MOD_RES (13)..(13): F or A
DLYYGPXTXYXXXNL

SEQ ID NO: 883 - protein, 12 aa, Artificial Sequence
  Description of Artificial Sequence: Synthetic peptide
  MOD_RES (3)..(3): S or R
  MOD_RES (4)..(4): D or P
  MOD_RES (5)..(5): G, S, or F
  MOD_RES (12)..(12): L or A
ATXXXSGSNFQX

SEQ ID NO: 884 - protein, 11 aa, Artificial Sequence
  Description of Artificial Sequence: Synthetic peptide
QASQNIYSNLA

SEQ ID NO: 885 - protein, 17 aa, Artificial Sequence
  Description of Artificial Sequence: Synthetic peptide
GISRSAGNTDYSDSVKG

SEQ ID NO: 886 - protein, 16 aa, Artificial Sequence
  Description of Artificial Sequence: Synthetic peptide
IVSSGGTTYYASWAKG

SEQ ID NO: 887 - protein, 16 aa, Artificial Sequence
  Description of Artificial Sequence: Synthetic peptide
IVSSGGTTYYADVSKG

SEQ ID NO: 888 - protein, 25 aa, Artificial Sequence
  Description of Artificial Sequence: Synthetic peptide
  SITE (1)..(25): This sequence may encompass 1-5 "Gly GLy Gly Gly Ser" repeating units
GGGGSGGGGSGGGGSGGGGSGGGGS

SEQ ID NO: 889 - protein, 15 aa, Artificial Sequence
  Description of Artificial Sequence: Synthetic peptide
GGGGSGGGGSGGGGS

SEQ ID NO: 890 - protein, 20 aa, Artificial Sequence
  Description of Artificial Sequence: Synthetic peptide
GGGGSGGGGSGGGGSGGGGS

SEQ ID NO: 891 - protein, 21 aa, Artificial Sequence
  Description of Artificial Sequence: Synthetic peptide
GGGGSGGGGSGGGGSGGGGAS

SEQ ID NO: 892 - protein, 72 aa, Artificial Sequence
  Description of Artificial Sequence: Synthetic polypeptide
  SITE (1)..(8): This region may encompass 1-8 residues
  SITE (10)..(17): This region may encompass 1-8 residues
  SITE (19)..(26): This region may encompass 1-8 residues
  SITE (28)..(35): This region may encompass 1-8 residues
  SITE (37)..(44): This region may encompass 1-8 residues
  SITE (46)..(53): This region may encompass 1-8 residues
  SITE (55)..(62): This region may encompass 1-8 residues
  SITE (64)..(71): This region may encompass 1-8 residues
  SITE (1)..(72): This sequence may encompass 1-8 "(Gly)n-Ser" repeating units where n=1-8
  See specification as filed for detailed description of substitutions and preferred embodiments
GGGGGGGGSGGGGGGGGSGGGGGGGGSGGGGGGGGSGGGGGGGGSGGGGGGGGSGGGGGGGGSGGGGGGGGS

SEQ ID NO: 893 - DNA, 64 bp, Oryctolagus sp.
cagttcactctcaccattagcggcctggagtgtgttgatgctgccacctactactgtcaaggct

SEQ ID NO: 894 - protein, 5 aa, Artificial Sequence
  Description of Artificial Sequence: Synthetic peptide
DGGGS

SEQ ID NO: 895 - protein, 5 aa, Artificial Sequence
  Description of Artificial Sequence: Synthetic peptide
TGEKP

SEQ ID NO: 896 - protein, 4 aa, Artificial Sequence
  Description of Artificial Sequence: Synthetic peptide
GGRR

SEQ ID NO: 897 - protein, 14 aa, Artificial Sequence
  Description of Artificial Sequence: Synthetic peptide
EGKSSGSGSESKVD

SEQ ID NO: 898 - protein, 18 aa, Artificial Sequence
  Description of Artificial Sequence: Synthetic peptide
KESGSVSSEQLAQFRSLD

SEQ ID NO: 899 - protein, 8 aa, Artificial Sequence
  Description of Artificial Sequence: Synthetic peptide
GGRRGGGS

SEQ ID NO: 900 - protein, 9 aa, Artificial Sequence
  Description of Artificial Sequence: Synthetic peptide
LRQRDGERP

SEQ ID NO: 901 - protein, 12 aa, Artificial Sequence
  Description of Artificial Sequence: Synthetic peptide
LRQKDGGGSERP

SEQ ID NO: 902 - protein, 18 aa, Artificial Sequence
  Description of Artificial Sequence: Synthetic peptide
GSTSGSGKPGSGEGSTKG

SEQ ID NO: 903 - DNA, 85 bp, Artificial Sequence
  Description of Artificial Sequence: Synthetic oligonucleotide
  modified_base (85)..(85): a, c, t or g
ggttcaaaggcagtggatctgggacacagttcactctcaccatcagcggcgtgcagtgtgacgatgctgccacttactactgtcn

SEQ ID NO: 904 - DNA, 85 bp, Oryctolagus sp.
ggttcaaaggcagtggatctgggacacagttcactctcaccatcagtggcgtggagtgtgacgatgctgccacttactactgtgc

SEQ ID NO: 905 - DNA, 85 bp, Oryctolagus sp.
ggttcagcggcagtggatctgggacacagttcactctcaccatcagtggcgtacagtgtgacgatgctgccacttactactgtca

SEQ ID NO: 906 - DNA, 85 bp, Oryctolagus sp.
ggttcaaaggcagtggatctgggacagagtacactcttaccatcagcggtgtgcagtgtgacgatgctgccacttactactgtca

SEQ ID NO: 907 - DNA, 85 bp, Oryctolagus sp.
ggttcagtggcagtggatctgggacacagttcactctcaccatcagcggcgtgcagtgtgacgatgctgccacttactactgtca

SEQ ID NO: 908 - DNA, 85 bp, Oryctolagus sp.
ggttcagcggcagtggatctgggaaacagttcactctcaccatcagtggcgtgcagtgtgacgatgctgccacttactactgtgc

SEQ ID NO: 909 - DNA, 85 bp, Oryctolagus sp.
ggttcaacggcagtggatctgggacacagtttactctcaccatcagcggcgtgcagtgtgacgatgctgccacttactactgtca

SEQ ID NO: 910 - DNA, 85 bp, Oryctolagus sp.
ggttcagcggcagtggatctgggacacagtttactctcaccatcagcggcgtgcagtgtgacgatgctgccacttactactgtca

SEQ ID NO: 911 - DNA, 85 bp, Oryctolagus sp.
ggttcaaaggcagtggatctgggacacagttcactctcaccatcaacggcgtgcagtgtgacgatgctgccacttactactgtca

SEQ ID NO: 912 - DNA, 85 bp, Oryctolagus sp.
ggttcaaaggcagtggatctgggacacagttcactctcaccatcagtggcgtgcagtgtgacgatgctgccacttactactgtct

SEQ ID NO: 913 - DNA, 85 bp, Oryctolagus sp.
ggttcaaaggcagtggatctgggacacagttcactctcaccatcagcgacctggagtgtgccgatgctgccacttactactgtca

SEQ ID NO: 914 - DNA, 85 bp, Oryctolagus sp.
ggttcaaaggcagtggatctgggacacagttcactctcaccatcaacggcgtgcagtgtgacgatgctgccacttactactgtgc

SEQ ID NO: 915 - DNA, 85 bp, Oryctolagus sp.
ggttcaaaggcagtggatctgggacacagttcactctcaccatcagtggcgtgcagtgtgacgatgctgccacttactactgtca

SEQ ID NO: 916 - DNA, 85 bp, Oryctolagus sp.
ggttcaaaggcagtggatttgggacacagttcactctcaccatcagcggtgcacagtgtgacgatgctgccacttactactgtgc

SEQ ID NO: 917 - DNA, 85 bp, Oryctolagus sp.
ggttcaaaggcagtggatctgggacacagttcactctcaccatcagcgacgtgcagtgtgacgatgctgccacttactactgtca

SEQ ID NO: 918 - DNA, 85 bp, Oryctolagus sp.
ggttcaaaggcagtggatctgggacagagtacactctcaccatcagtggcgtgcagtgtgccgatgctgccacttactactgtca

SEQ ID NO: 919 - DNA, 85 bp, Oryctolagus sp.
ggttcagcggcagtggatctgggacacagttcactctcaccatcagcggcgtgcagtgtgacgatgctgccacttactactgtct

SEQ ID NO: 920 - DNA, 85 bp, Oryctolagus sp.
ggttccgtggcagtggatctgggacacagttcactcttaccatcagcggcatgaaggctgaagatgttgccacctattactgtca

SEQ ID NO: 921 - DNA, 85 bp, Oryctolagus sp.
ggttcaaaggcagtggatctgggacacagttcactctcaccatcagcggcgtgcagtgtgacgatgctgccacttactactgtca

SEQ ID NO: 922 - DNA, 85 bp, Oryctolagus sp.
ggttcaaaggcagtggatctgggacagagtacactctcaccatcagcggtgtgcagtgtgacgatgctgccacttactactgtct

SEQ ID NO: 923 - DNA, 85 bp, Oryctolagus sp.
ggttcagcggcagtggatctgggacagagttcactctcaccatcagcgacctggagtgtgccgatgctgccacttactactgtca

SEQ ID NO: 924 - DNA, 85 bp, Oryctolagus sp.
ggttcaaaggcagtagatctgggacagagttcactctcaccatcagcgacctggagtgtgccgatgctgccacttactactgtca

SEQ ID NO: 925 - DNA, 85 bp, Oryctolagus sp.
ggttcaaaggcagtggatctgggacacagttcactctcaccatcagtggtgtgcagtgtgacgatgctgccacttactactgtct

SEQ ID NO: 926 - DNA, 85 bp, Oryctolagus sp.
ggttcaaaggcagtggatctgggacagagttcactctcaccatcagcgacctggagtgtgccgatgctgccacttactactgtca

SEQ ID NO: 927 - DNA, 85 bp, Oryctolagus sp.
ggttcagcggcagtggatctgggacagagtacactctcaccatcagcggcgtgcagtgtgacgatgctgccacttactactgtca

SEQ ID NO: 928 - DNA, 85 bp, Oryctolagus sp.
ggttcaaaggcagtggatctgggacacagttcactctcaccatcagcggggtgcagcctggagatgctgccacttactactgtct

SEQ ID NO: 929 - DNA, 85 bp, Oryctolagus sp.
ggttcaaaggcagtggatctgggacacagttcactctcaccatcagtggcgtgcagtgtgacgatgctgccacttactactgtgc

SEQ ID NO: 930 - DNA, 85 bp, Oryctolagus sp.
ggttcaaaggcagtggatctgggacagagtacactctcaccatcagcgacctggagtgtgccgatgctgccacttactactgtca

SEQ ID NO: 931 - DNA, 85 bp, Oryctolagus sp.
gggtcagcagcagtggatcagggacagagttcactctcaccatcagcggggtgcagcctggagatgctgccacttactactgtct

SEQ ID NO: 932 - DNA, 83 bp, Oryctolagus sp.
ggttcagcggcagtggatctgggacacagtttactctcaccatcagcggcgtgcagtgtgacgatgctgccacttactactgt

SEQ ID NO: 933 - DNA, 85 bp, Oryctolagus sp.
ggttcaaaggcagtggatctgggacacagttcactctcaccatcaacggcgtgcagtgtgacgatgctgccacttactactgtct

SEQ ID NO: 934 - DNA, 85 bp, Oryctolagus sp.
ggttccgtggcagtggatctgggacacagttcactctcaccatcaacggcgtgcagtgtgacgatgctgccacttactactgtgc

SEQ ID NO: 935 - DNA, 70 bp, Artificial Sequence
  Description of Artificial Sequence: Synthetic oligonucleotide
gggacacagttcactctcaccatcagcgacgtggagtgtgacgatgctgccacttactactgtcaaggct

SEQ ID NO: 936 - DNA, 70 bp, Artificial Sequence
  Description of Artificial Sequence: Synthetic oligonucleotide
gggacacagttcactctcaccatcagcgaagtgcagtgtgacgatgctgccacttattattgtcaaggcg

SEQ ID NO: 937 - DNA, 70 bp, Artificial Sequence
  Description of Artificial Sequence: Synthetic oligonucleotide
gggacatatttcactctcaccatcagcgacctggagtgtgccgatgctgccacttactactgtcaaagct

SEQ ID NO: 938 - DNA, 70 bp, Artificial Sequence
  Description of Artificial Sequence: Synthetic oligonucleotide
gggacagactacactctcaccatcagcgacctggagtgtgccgatgctgccacttactactgtcaaagta

SEQ ID NO: 939 - DNA, 70 bp, Artificial Sequence
  Description of Artificial Sequence: Synthetic oligonucleotide
gggacacagttcactctcaccatcagcggcgtgcagtgtgacgatgctgccacatacttctgtctaggcg

SEQ ID NO: 940 - DNA, 70 bp, Artificial Sequence
  Description of Artificial Sequence: Synthetic oligonucleotide
gggacacagttcactctcaccatcagcgacctggagtgtgacgatgctgccacttattattgcctaggcg

SEQ ID NO: 941 - DNA, 70 bp, Artificial Sequence
  Description of Artificial Sequence: Synthetic oligonucleotide
gggacacagttcactctcaccatcagcgatgtggtgtgtgacgatgctgccacttactactgtgcagcct

SEQ ID NO: 942 - DNA, 70 bp, Artificial Sequence
  Description of Artificial Sequence: Synthetic oligonucleotide
gggacagaattcactctcaccattagcggcgtgcagtgtgacgatgctgccacttactactgtcaaagct

SEQ ID NO: 943 - DNA, 70 bp, Artificial Sequence
  Description of Artificial Sequence: Synthetic oligonucleotide
gggacasacttcactctcacsatcagcgacctggagtgtgctgatgctgccrcttattattgtctaaaca

SEQ ID NO: 944 - DNA, 70 bp, Artificial Sequence
  Description of Artificial Sequence: Synthetic oligonucleotide
gggacacagttcactctcaccatcagcggcgtgcagtgtgacgatgctgccacttactactgtcaaaatt

SEQ ID NO: 945 - DNA, 70 bp, Artificial Sequence
  Description of Artificial Sequence: Synthetic oligonucleotide
gggacacagttcactctcaccatcagcgacctggagtgtgccgatgctgccgcttactactgtcaaacct

SEQ ID NO: 946 - DNA, 70 bp, Artificial Sequence
  Description of Artificial Sequence: Synthetic oligonucleotide
gggacacagttcactctcaccatcagcgacgtgcagtgtgacgatgctgccacttactactgtgcaggcg

SEQ ID NO: 947 - DNA, 70 bp, Artificial Sequence
  Description of Artificial Sequence: Synthetic oligonucleotide
gggacacagttcactctcgccatcagcggcgtgcaatgtgatgatgctgccacttactactgcctaggcg

SEQ ID NO: 948 - DNA, 70 bp, Artificial Sequence
  Description of Artificial Sequence: Synthetic oligonucleotide
gggacacagttcattctcaccatcagcgatgtggtgtgtgacgatgctgccacttactactgtgcaggat

SEQ ID NO: 949 - DNA, 70 bp, Artificial Sequence
  Description of Artificial Sequence: Synthetic oligonucleotide
gggacacagttcaatctcaccatcagtggcgtgcagtgtgacgatgctgccacttactactgtcaaggct

SEQ ID NO: 950 - DNA, 70 bp, Artificial Sequence
  Description of Artificial Sequence: Synthetic oligonucleotide
gggacacagttcactctcaccatcagcggcgtgcagtgtgacgatgctgccacttactactgtcaagcct

SEQ ID NO: 951 - DNA, 70 bp, Artificial Sequence
  Description of Artificial Sequence: Synthetic oligonucleotide
gggacacagttcactctcaccatcagcgacctggagtgtgccgatgctgccacttactactgtctagccg

SEQ ID NO: 952 - DNA, 70 bp, Artificial Sequence
  Description of Artificial Sequence: Synthetic oligonucleotide
gggacacagttcactctcaccatcagcgacctggagtgtgccgatgctgccacttactactgtcaatgtt

SEQ ID NO: 953 - DNA, 70 bp, Artificial Sequence
  Description of Artificial Sequence: Synthetic oligonucleotide
gggacacagttcactctcaccatcagcgacttggagtgtgacgatgctgccacttactactgtgcaggcc

SEQ ID NO: 954 - protein, 8 aa, Artificial Sequence
  Description of Artificial Sequence: Synthetic peptide
  SITE (1)..(8): This sequence may encompass 1-8 residues
GGGGGGGG

What is claimed:

1. An antigen binding protein that specifically recognizes a target Melanoma-Associated Antigen A4 (MAGE-A4) peptide-MHC (pMHC), comprising:
    (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 657) and an HCDR3 amino acid sequence of DLYYGPSTYFVANL (SEQ ID NO: 731); and
    (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQL (SEQ ID NO: 879).

2. The antigen binding protein of claim 1, comprising:
    (a) an antibody heavy chain variable (VH) domain comprising a framework region, an HCDR1 region, an HCDR2 region, and an HCDR3 region, wherein the VH domain comprises an amino acid sequence set forth in SEQ ID NO: 583, or an amino acid sequence with at least 80% identity to the framework region of the amino acid sequence set forth in SEQ ID NO: 583 and 100% identity to the HCDR1 region, HCDR2 region, and HCDR3 region set forth in SEQ ID NO: 583; and
    (b) an antibody light chain variable (VL) domain comprising a framework region, an LCDR1 region, an LCDR2 region, and an LCDR3 region, wherein the VL domain comprises an amino acid sequence set forth in SEQ ID NO: 805, or an amino acid sequence with at least 80% identity to the framework region of the amino acid sequence set forth in SEQ ID NO: 805 and 100% identity to the LCDR1 region, LCDR2 region, and LCDR3 region set forth in SEQ ID NO: 805.

3. The antigen binding protein of claim 1, wherein the antigen binding protein is a humanized antigen binding protein.

4. A bispecific antigen binding protein, comprising at least a first antigen binding domain comprising the antigen binding protein of claim 1, and at least a second antigen binding domain with specificity for a cell surface protein of an immune cell.

5. The bispecific antigen binding protein of claim 4, further comprising an immune checkpoint inhibitor.

6. A pharmaceutical composition comprising the antigen binding protein of claim 1, and a pharmaceutically acceptable carrier.

7. An antigen binding protein that specifically recognizes a target Melanoma-Associated Antigen A4 (MAGE-A4) peptide-WIC (pMHC), comprising:
   (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 886), and an HCDR3 amino acid sequence of DLYYGPTTYSAANL (SEQ ID NO: 727); and
   (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRDFSGSNFQL (SEQ ID NO: 875).

8. An antigen binding protein that specifically recognizes a target Melanoma-Associated Antigen A4 (MAGE-A4) peptide-WIC (pMHC), comprising:
   (a) an antibody heavy chain variable (VH) domain comprising an HCDR1 amino acid sequence of SNYAMS (SEQ ID NO: 469), an HCDR2 amino acid sequence of IVSSGGTTYYADSVKG (SEQ ID NO: 658), and an HCDR3 amino acid sequence of DLYYGPNTDYSAANL (SEQ ID NO: 732); and
   (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQA (SEQ ID NO: 880).

9. An antigen binding protein that specifically recognizes a target Melanoma-Associated Antigen A4 (MAGE-A4) peptide-WIC (pMHC), comprising:
   (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 624), and an HCDR3 amino acid sequence of DLYYGPTTYSAFNL (SEQ ID NO: 698); and
   (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATRPSSGSNFQA (SEQ ID NO: 846).

10. An antigen binding protein that specifically recognizes a target Melanoma-Associated Antigen A4 (MAGE-A4) peptide-WIC (pMHC), comprising:
    (a) an antibody heavy chain variable (VH) domain comprising an HCDR1 amino acid sequence of SNYAMS (SEQ ID NO: 469), an HCDR2 amino acid sequence of IVSSGGTTYYASWAKG (SEQ ID NO: 470), and an HCDR3 amino acid sequence of DLYYGPTTYSAFNL (SEQ ID NO: 471); and
    (b) an antibody light chain variable (VL) domain comprising an LCDR1 amino acid sequence of TADTLSRSYAS (SEQ ID NO: 472), an LCDR2 amino acid sequence of RDTSRPS (SEQ ID NO: 473), and an LCDR3 amino acid sequence of ATSDGSGSNFQL (SEQ ID NO: 474).

11. The antigen binding protein of claim 1, comprising:
    (a) an antibody heavy chain variable (VH) domain comprising a framework region, an HCDR1 region, an HCDR2 region, and an HCDR3 region, wherein the VH domain comprises an amino acid sequence set forth in SEQ ID NO: 583, or an amino acid sequence with at least 80% identity to the framework region of the amino acid sequence set forth in SEQ ID NO: 583 and 100% identity to the HCDR1 region, HCDR2 region, and HCDR3 region set forth in SEQ ID NO: 583; and
    (b) an antibody light chain variable (VL) domain comprising a framework region, an LCDR1 region, an LCDR2 region, and an LCDR3 region, wherein the VL domain comprises an amino acid sequence set forth in SEQ ID NO: 805, or an amino acid sequence with at least 80% identity to the framework region of the amino acid sequence set forth in SEQ ID NO: 805 and 100% identity to the LCDR1 region, LCDR2 region, and LCDR3 region set forth in SEQ ID NO: 805.

12. The antigen binding protein of claim 7, comprising:
    (a) an antibody heavy chain variable (VH) domain comprising a framework region, an HCDR1 region, an HCDR2 region, and an HCDR3 region, wherein the VH domain comprises an amino acid sequence set forth in SEQ ID NO: 579, or an amino acid sequence with at least 80% identity to the framework region of the amino acid sequence set forth in SEQ ID NO: 579 and 100% identity to the HCDR1 region, HCDR2 region, and HCDR3 region set forth in SEQ ID NO: 579; and
    (b) an antibody light chain variable (VL) domain comprising a framework region, an LCDR1 region, an LCDR2 region, and an LCDR3 region, wherein the VL domain comprises an amino acid sequence set forth in SEQ ID NO: 801 or an amino acid sequence with at least 80% identity to the framework region of the amino acid sequence set forth in SEQ ID NO: 801 and 100% identity to the LCDR1 region, LCDR2 region, and LCDR3 region set forth in SEQ ID NO: 801.

13. The antigen binding protein of claim 8, comprising:
    (a) an antibody heavy chain variable (VH) domain comprising a framework region, an HCDR1 region, an HCDR2 region, and an HCDR3 region, wherein the VH domain comprises an amino acid sequence set forth in SEQ ID NO: 584, or an amino acid sequence with at least 80% identity to the framework region of the amino acid sequence set forth in SEQ ID NO: 584 and 100% identity to the HCDR1 region, HCDR2 region, and HCDR3 region set forth in SEQ ID NO: 584; and
    (b) an antibody light chain variable (VL) domain comprising a framework region, an LCDR1 region, an LCDR2 region, and an LCDR3 region, wherein the VL domain comprises an amino acid sequence set forth in SEQ ID NO: 806 or an amino acid sequence with at least 80% identity to the framework region of the amino acid sequence set forth in SEQ ID NO: 806 and 100% identity to the LCDR1 region, LCDR2 region, and LCDR3 region set forth in SEQ ID NO: 806.

14. The antigen binding protein of claim 9, comprising:
    (a) an antibody heavy chain variable (VH) domain comprising a framework region, an HCDR1 region, an HCDR2 region, and an HCDR3 region, wherein the VH domain comprises an amino acid sequence set forth in SEQ ID NO: 550, or an amino acid sequence with at least 80% identity to the framework region of the amino acid sequence set forth in SEQ ID NO: 550 and 100% identity to the HCDR1 region, HCDR2 region, and HCDR3 region set forth in SEQ ID NO: 550; and
    (b) an antibody light chain variable (VL) domain comprising a framework region, an LCDR1 region, an LCDR2 region, and an LCDR3 region, wherein the VL domain comprises an amino acid sequence set forth in SEQ ID NO: 772 or an amino acid sequence with at least 80% identity to the framework region of the amino acid sequence set forth in SEQ ID NO: 772 and 100% identity to the LCDR1 region, LCDR2 region, and LCDR3 region set forth in SEQ ID NO: 772.

15. The antigen binding protein of claim 1, comprising a single chain variable fragment (scFv), a Fab fragment, a Fab' fragment, a Fv fragment, or a diabody.

16. The bispecific antigen binding protein of claim 4, wherein the immune cell is selected from the group consisting of a T cell, a B cell, a natural killer (NK) cell, a natural killer T (NKT) cell, a neutrophil cell, a monocyte, and a macrophage.

17. The bispecific antigen binding protein of claim 4, wherein the cell surface protein of an immune cell is selected from the group consisting of CD3, TCRα, TCRβ, CD16, NKG2D, CD89, CD64, and CD32.

18. The bispecific antigen binding protein of claim 4, wherein the at least first antigen binding domain comprises an scFv, and the at least second antigen binding domain comprises a Fab.

19. The bispecific antigen binding protein of claim 4, wherein the bispecific antigen binding protein is multivalent.

20. The bispecific antigen binding protein of claim 5, wherein the immune checkpoint inhibitor is selected from the group consisting of an anti-CTLA-4 antibody, an anti-PD-L1 antibody, an anti-PD-1 antibody, an anti-TIM-3 antibody, an anti-LAG-3 antibody, an anti-BTLA antibody, an anti-VISTA antibody, and combinations thereof.

21. The antigen binding protein of claim 8, wherein the antigen binding protein is a humanized antigen binding protein.

22. The antigen binding protein of claim 8, comprising a single chain variable fragment (scFv), a Fab fragment, a Fab' fragment, a Fv fragment, or a diabody.

23. A pharmaceutical composition comprising the antigen binding protein of claim 8, and a pharmaceutically acceptable carrier.

24. A bispecific antigen binding protein, comprising at least a first antigen binding domain comprising the antigen binding protein of claim 8, and at least a second antigen binding domain with specificity for a cell surface protein of an immune cell.

25. The bispecific antigen binding protein of claim 24, wherein the immune cell is selected from the group consisting of a T cell, a B cell, a natural killer (NK) cell, a natural killer T (NKT) cell, a neutrophil cell, a monocyte, and a macrophage.

26. The bispecific antigen binding protein of claim 24, wherein the cell surface protein of an immune cell is selected from the group consisting of CD3, TCRα, TCRβ, CD16, NKG2D, CD89, CD64, and CD32.

27. The bispecific antigen binding protein of claim 24, wherein the at least first antigen binding domain comprises an scFv, and the at least second antigen binding domain comprises a Fab.

28. The bispecific antigen binding protein of claim 24, wherein the bispecific antigen binding protein is multivalent.

29. The bispecific antigen binding protein of claim 24, further comprising an immune checkpoint inhibitor.

30. The bispecific antigen binding protein of claim 29, wherein the immune checkpoint inhibitor is selected from the group consisting of an anti-CTLA-4 antibody, an anti-PD-L1 antibody, an anti-PD-1 antibody, an anti-TIM-3 antibody, an anti-LAG-3 antibody, an anti-BTLA antibody, an anti-VISTA antibody, and combinations thereof.

\* \* \* \* \*